(12) United States Patent
Li

(10) Patent No.: US 9,952,224 B2
(45) Date of Patent: Apr. 24, 2018

US009952224B2

(54) DETECTION METHOD FOR 305 FERTILITY-ASSOCIATED SPERM LOCALIZATION PROTEINS EXPRESSED IN HUMAN TESTIS AND EPIDIDYMIS

(75) Inventor: Jianyuan Li, Yantai (CN)

(73) Assignee: Yantai Ju Jie Bioengineering Limited Company, Yantai, Shandong (CN)

( * ) Notice: Subject to any disclaimer, the term of this patent is extended or adjusted under 35 U.S.C. 154(b) by 1017 days.

(21) Appl. No.: 13/700,218

(22) PCT Filed: May 18, 2011

(86) PCT No.: PCT/CN2011/074274
§ 371 (c)(1),
(2), (4) Date: Mar. 12, 2013

(87) PCT Pub. No.: WO2011/147274
PCT Pub. Date: Jan. 12, 2011

(65) Prior Publication Data
US 2013/0184174 A1    Jul. 18, 2013

(30) Foreign Application Priority Data

May 27, 2010    (CN) .......................... 2010 1 0195377

(51) Int. Cl.
*G01N 33/68*    (2006.01)

(52) U.S. Cl.
CPC ....... *G01N 33/689* (2013.01); *G01N 33/6893* (2013.01); *G01N 2800/34* (2013.01); *G01N 2800/367* (2013.01)

(58) Field of Classification Search
None
See application file for complete search history.

(56) References Cited

U.S. PATENT DOCUMENTS

2006/0223131 A1    10/2006    Schweitzer et al.
2009/0098189 A1    4/2009    Buchmann et al.

FOREIGN PATENT DOCUMENTS

| CN | 1840544 | 10/2006 |
|---|---|---|
| CN | 1869700 | 11/2006 |
| CN | 101084189 | 12/2007 |
| CN | 101519448 | 9/2009 |
| CN | 101525616 | 9/2009 |
| WO | 2010/025548 | 3/2010 |

OTHER PUBLICATIONS

Carlsson (Journal of Andrology vol. 25 No. 5 Sep./Oct. 2004).*
De Mateo et al., Proteomics, 2007; 7: 4264-4277.*
Hall et al., Mech Ageing Dev. 2007; 128: 161-167.*
Gene ID information for mouse Hsp90aa1, downloaded on Jun. 16, 2017 from ncbi.nlm.nih.gov/gene/15519; 10 pages total.*
Gene ID information for mouse Lyzl6, downloaded on Jun. 16, 2017 from ncbi.nlm.nih.gov/gene/69444; 6 pages total.*
Gene ID information for mouse Gapdh, downloaded on Jun. 16, 2017 from ncbi.nlm.nih.gov/gene/14433; 10 pages total.*
Liu et al., "Advances in Researches on Epididymal WFDC-type Serine Protease Inhibitors," National Journal of Andrology, vol. 14, No. 11 (Nov. 2008) pp. 1027-1030.
Galeraud-Denis et al., "New insights about the evaluation of human sperm quality: the aromatase example," Folia Histochemica et Cytobiologica, vol. 47, No. 5 (2009) pp. S13-S17.
Cheng et al., "Human ribonuclease 9, a member of ribonuclease A superfamily, specifically expressed in epididymis, is a novel sperm-binding protein," Asian Journal of Andrology (2009), pp. 240-251.
International Search Report for international application No. PCT/CN2011/074274, dated Aug. 25, 2011 (6 pages).
International Preliminary Report on Patentability for international application No. PCT/CN2011/074274, dated Aug. 24, 2012 (5 pages).

* cited by examiner

*Primary Examiner* — Christina M Borgeest
(74) *Attorney, Agent, or Firm* — Hamre, Schumann, Mueller & Larson, P.C.

(57) ABSTRACT

A detection method for 305 fertility-associated sperm localization protein expressed in human testis and epididymis. The method includes qualitatively or quantitatively detecting for sperm localization proteins on a sperm or in seminal plasma via capture agents for the sperm localization proteins. The sperm localization proteins belong to an important protein group related to human sperm maturation and fertility. The method provides a diagnostic approach for male infertility.

16 Claims, 3 Drawing Sheets

Figures

DETECTION METHOD FOR 305 FERTILITY-ASSOCIATED SPERM LOCALIZATION PROTEINS EXPRESSED IN HUMAN TESTIS AND EPIDIDYMIS

TECHNICAL FIELD OF INVENTION

This invention relates to the detection field, specifically to the detection method for 305 fertility-associated sperm localization proteins expressed in human testis and epididymis. It includes the method for detecting sperm localization proteins qualitatively and quantitatively by marking techniques such as using fluorescence markers, enzyme marker, silver stain, biotin, isotopes, chips, etc. The invention further relates to the protein chips for detecting said sperm localization proteins and the uses thereof.

BACKGROUND OF INVENTION

Male infertility is one of the major factors causing infertility. According to the report of the World Health Organization (WHO) in 2,000, the global infertility rate was about 15%, in which male factors accounted for about 50%. Infertility rate in some countries in Europe is up to 30%. There are complex and various factors for male infertility, including abnormal and dysfunction of many factors, such as anatomy structure and function of the reproductive system, hormone regulation, the genetic material, and infection immunity.

At present, most researches for these factors remain at single gene level or the genome level. However, protein is the real executor of physical function in the organism, therefore, the above molecular genetics research can not reflect the information regarding post-transcriptional regulation for a gene, changes in protein expression levels, or post-translational modification for a protein, etc. Besides, the mRNA level in cells will not be consistent with the protein expression abundance, therefore, it is particularly important to study the mechanism for male infertility on the protein level.

There are studies indicating that male infertility is not an independent disease, but resulted from the synthetic action of various diseases or multiple factors. The causes for male infertility are quite complex, and at present, the methods for routine semen detection are limited, therefore, the expression level for proteins in the seminal plasma can not be analyzed systemically.

In summary, so far, little has been known about male infertility-associated proteins during human sperm maturity, not to mention the detection methods for such proteins. Thus, it is urgent to develop effective methods and products to detect male fertility-associated proteins.

SUMMARY OF INVENTION

The purpose of the present invention is to provide an effective method and the product to detect male fertility-associated protein.

In the first aspect of the invention, the use of a group of capture reagents for human sperm maturation and male fertility-associated proteins is provided, wherein said male fertility-associated proteins are listed in Table 2 but not in Table 1, wherein said capture reagents are used to prepare chips or kits for detecting expression of male fertility-associated proteins from male individuals.

In another preferred embodiment, said male fertility-associated proteins comprise at least 5, 10, 15, 20, 25, 30, 40, 50, 60, 70, 80, 90, 100, 150, 200, 250, 300 proteins listed in Table 2.

In another preferred embodiment, said reagents are protein chips.

In another preferred embodiment, said detection is the qualitative or quantitative detection.

In another preferred embodiment, said detection is to detect the seminal plasma samples from male individuals.

In another preferred embodiment, said detection is to detect the sperm samples of male individuals.

In another preferred embodiment, said capture reagents are antibodies, including monoclonal antibodies or polyclonal antibodies.

In another preferred embodiment, said antibodies provide one or more detectable markers.

In another preferred embodiment, said markers generally include immunofluorescence marker, enzyme marker, silver stain, biotin, isotopes, etc.

In another preferred embodiment, said male individuals are human, especially the infertile males or the spouses of those females without any child within 1 year after marriage.

In the second aspect of the invention, a chip which can be used for detecting the sperm binding protein expressed in human testis and epididymis is provided, said chip comprising:

a solid phase support and detection points for male fertility-associated proteins on said solid phase support, wherein said male fertility-associated proteins are listed in Table 2 but not in Table 1.

In another preferred embodiment, said capture reagents for male fertility-associated proteins (such as antibodies) are fixed at said detective points.

In another preferred embodiment, the male fertility-associated proteins comprise at least 5, 10, 15, 20, 25, 30, 40, 50, 60, 70, 80, 90, 100, 150, 200, 250, 300 protein listed in Table 2.

In another preferred embodiment, said solid phase support is selected from the group consisting of the following: glass sheets, plastic sheets, nitrocellulose membrane, polyvinylidene fluoride film, microspheres, etc.

In the third aspect of the invention, a method is provided for identifying male infertility-associated proteins with the above chips, wherein said male fertility-associated proteins are listed in Table 2 but not in Table 1. Said identifying method comprises the following steps:

a) contacting the seminal plasma sample from a subject to be tested with a chip containing capture reagents against the infertility-associated proteins;

b) capturing the infertility-associated proteins from the sample and producing the first signal;

c) comparing the first signal with the signal from the standard (including the positive and negative control), thereby qualitatively or quantitatively determining the expression of said male infertility-associated proteins;

d) determining the candidate proteins resulting in the male infertility according to the expression.

It should be understood that in the present invention, any of the technical features specifically described above and below (such as in the Examples) can be combined with each other, thereby constituting new or preferred technical solutions that are not described one by one in the specification.

DESCRIPTION OF FIGURES

FIG. 1 shows the two-dimensional gel electrophoresis (2D) separation and mass spectrometry for epididymal and testicular proteins. Wherein, FIG. 1A shows the 2D reference spectrum of proteins in epididymis tissue; FIG. 1B shows the 2D reference spectrum of protein in epididymal luminal fluid; FIG. 1C shows the result of mass spectrometry identification for HEL-S-128m.

DETAILED DESCRIPTION OF INVENTION

Figure 1:
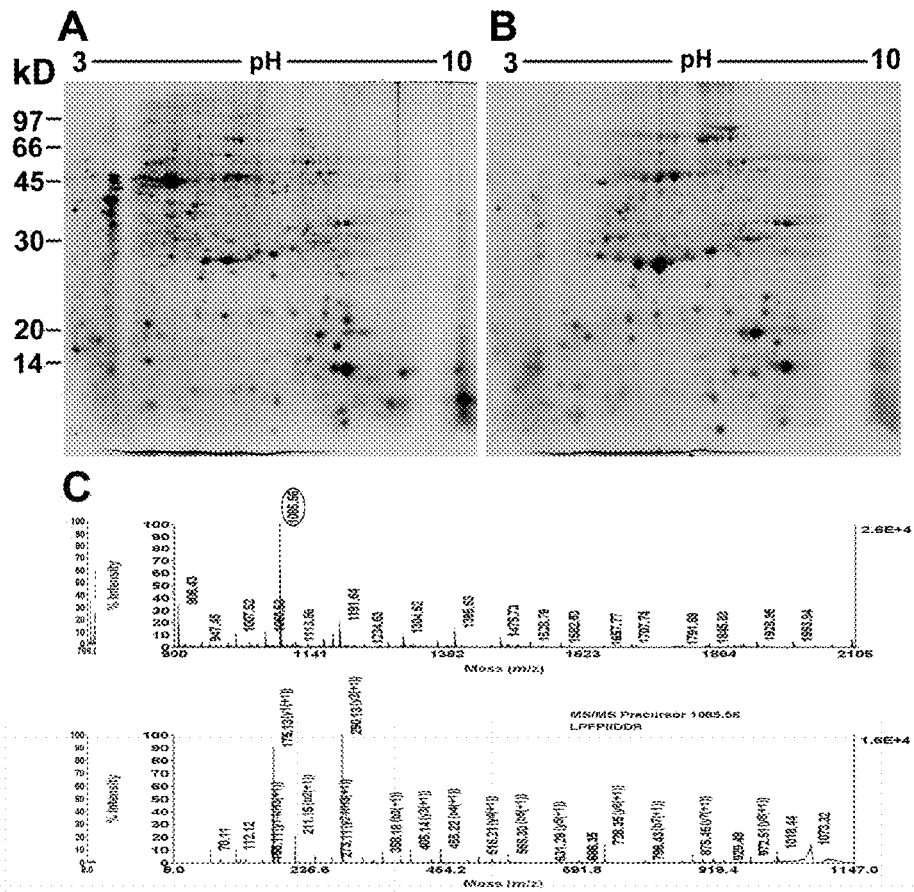
Figure 2:
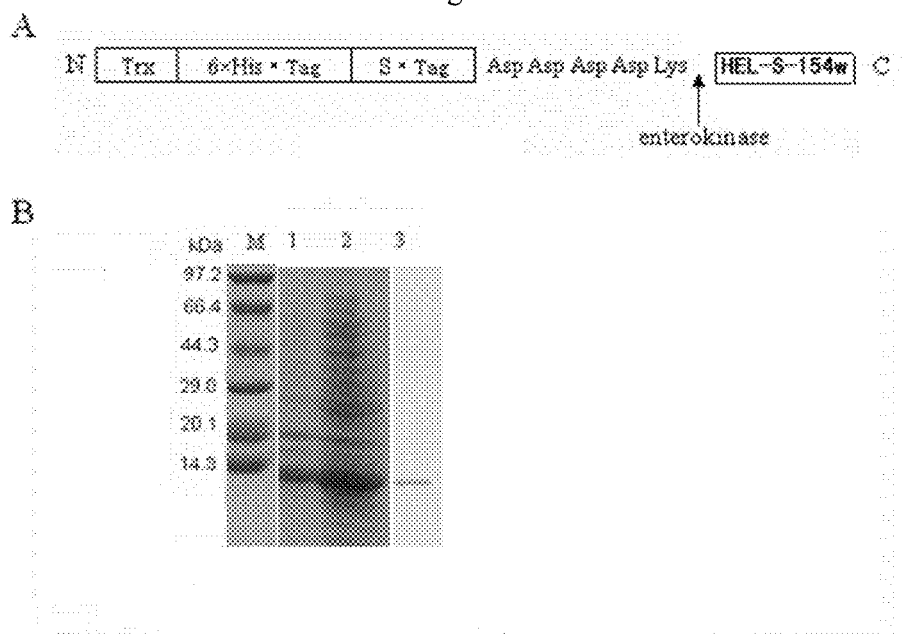
FIG. 2 shows the schematic diagram of a recombinant expression vector constructed with pET32b (+) vector.

Upon comprehensive and intensive studies, the inventors discovered a variety of specific proteins associated with male fertility and expressed in the human epididymis and testis for the first time, thereby confirming a group of important proteins associated with infertility occurrence. Based on the discovery, the inventors developed the detection methods and detection tools, such as chips, for male infertility-associated proteins, thus completing the present invention. It is helpful to reveal the molecular mechanism of the key proteins and the interaction between them by taking advantage of the group of male infertility-associated proteins disclosed by the present invention. Thereby, a new access to seek the causes of male infertility was provided.

Male Fertility-Associated Proteins

As used herein, the term "male fertility-associated proteins" refers to the proteins associated with male fertility and expressed in male testis and/or epididymis of male mammal (especially human). Generally, said male fertility-associated proteins include: sperm-protecting proteins, sperm motility-associated proteins, and ovum penetration-associated proteins.

As used herein, the term "mammal" refers to the species which are viviparous and breast-fed. One of representative mammals which belong to the vertebrate includes (but not limited to): human, monkey, goat, cattle, rabbit, horse, mouse, and rat, etc., especially human.

One type of male fertility associated proteins which are particularly suitable for the invention is the secretory proteins in testis and/or epididymis, some of which locate in the seminal plasma, while some of which locate in the sperm. In the invention, it is suggested that these male fertility-associated proteins were closely related to the processes, such as sperm maturity, etc., and were essential to the sperm for obtaining normal function.

As used herein, the terms "the proteins of the invention", "fertility-associated proteins of the invention", or "male fertility-associated proteins of the invention" can be used interchangeably. All of the terms refer to the proteins located in the sperm and expressed in testis and/or epididymis, and the relevance of which with male fertility has been disclosed in the present invention for the first time. Some typical proteins of the invention are listed in Table 2.

TABLE 1

Known male fertility-associated proteins with clear sperm localization.

| Series Number | Protein Numbers | Protein Names | Access Number of Reference Sequences | Sperm Localization | Function of the proteins |
|---|---|---|---|---|---|
| K1 | HEL-S-135P | ADAM7/GP83 | GQ891358 | Acrosome + Equatorial Region | Sperm Movement |
| K2 | HEL-S-171mP | CD52/HE5 | FJ460513 | Surface of Sperm in Epididymis | Sperm Movement |
| K3 | HEL-S-194m | Eppin | GQ891395 | Acrosome/Tail | Sperm Movement |
| K4 | HEL-S-170mP | HE3 | GQ891376 | Tail (Middle Piece + main Piece) | Sperm Movement |
| K5 | HEL-S-195E | NAG | GQ891410 | End of the Tail | Sperm Movement |
| K6 | HEL-S-193e | CRES | GQ891394 | Equatorial Region | Sperm-Egg Fusion |
| K7 | HEL-S-75p | GPX5 | FJ460514 | Post Acrosomal Region | Sperm-Egg Fusion |
| K8 | HEL-S-89n | grp78/hsp70 | EU794617 | Neck | Sperm-Egg Fusion |
| K9 | HEL-S-3a | LCN6 | GQ891284 | Acrosome | Sperm-Egg Fusion |
| K10 | HEL-S-4a | P34H | GQ891285 | Acrosome | Sperm-Egg Fusion |
| K11 | HEL-S-96n | SPAM1(PH-20) | EU794686 | Neck | Sperm-Egg Fusion |
| K12 | HEL-S-192a | Clusterin | GQ891391 | Acrosome | Sperm-Egg Fusion |
| K13 | HEL-S-49e | HE12 | GQ891321 | Equatorial Region | Sperm-Egg Fusion |
| K14 | HEL-S-154w | ESC42/DEFB118 | EF426755 | Neck | Antibiosis |

TABLE 2

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 1 | HEL-S-1a | PDXK | NM_003681.4 | EU794642 | Acrosome | Traversing the Zona Pellucida |
| 2 | HEL-S-2a | PRDX2 | NM_005809.4 | EU668325 | Acrosome | Traversing the Zona Pellucida |
| 3 | HEL-S-3a | LCN6 | NM_198946.2 | GQ891284 | Acrosome | Traversing the Zona Pellucida |
| 4 | HEL-S-4a | DCXR | NM_016286.2 | GQ891285 | Acrosome | Traversing the Zona Pellucida |
| 5 | HEL-S-5a | HSPA4 | NM_002154.3 | FJ224293 | Acrosome | Traversing the Zona Pellucida |
| 6 | HEL-S-6a | LYZL6 | NM_020426.1 | GQ472214 | Acrosome | Traversing the Zona Pellucida |
| 7 | HEL-S-7a | ADCYA | NM_018417.3 | GQ472219 | Acrosome | Traversing the Zona Pellucida |
| 8 | HEL-S-8a | NIT2 | NM_020202.4 | FJ224326 | Acrosome | Traversing the Zona Pellucida |
| 9 | HEL-S-9a | LMNB2 | NM_032737.2 | GQ891286 | Acrosome | Traversing the Zona Pellucida |
| 10 | HEL-S-10a | SAP18 | NM_005870.4 | GQ891287 | Acrosome | Traversing the Zona Pellucida |
| 11 | HEL-S-11a | NSF | NM_006178.2 | GQ891288 | Acrosome | Traversing the Zona Pellucida |
| 12 | HEL-S-12a | ATP6AP1 | NM_001183.4 | GQ891289 | Acrosome | Traversing the Zona Pellucida |
| 13 | HEL-S-13a | AK1 | NM_000476.2 | GQ891290 | Acrosome | Traversing the Zona Pellucida |
| 14 | HEL-S-14a | DCI | NM_001919.2 | GQ891291 | Acrosome | Traversing the Zona Pellucida |
| 15 | HEL-S-15a | LRRC8B | NM_001134476.1 | GQ891292 | Acrosome | Traversing the Zona Pellucida |
| 16 | HEL-S-16a | DLL1 | NM_005618.3 | GQ891293 | Acrosome | Traversing the Zona Pellucida |
| 17 | HEL-S-17a | GPD1 | NM_005276.2 | GQ891294 | Acrosome | Traversing the Zona Pellucida |
| 18 | HEL-S-18a | ANX2 | NM_001002857.1 | GQ891295 | Acrosome | Traversing the Zona Pellucida |
| 19 | HEL-S-19a | GPC1 | NM_002081.2 | GQ891296 | Acrosome | Traversing the Zona Pellucida |
| 20 | HEL-S-20a | GSTM5-5 | NM_000851.3 | GQ891297 | Acrosome | Traversing the Zona Pellucida |
| 21 | HEL-S-21a | DCS-1 | NM_014026.3 | GQ891298 | Acrosome | Traversing the Zona Pellucida |
| 22 | HEL-S-22a | VDAC2 | NM_003375.2 | GQ891299 | Acrosome | Traversing the Zona Pellucida |
| 23 | HEL-S-23a | LCA5 | NM_001122769.1 | GQ891300 | Acrosome | Traversing the Zona Pellucida |
| 24 | HEL-S-24a | TCEAL4 | NM_001006935.1 | GQ891301 | Acrosome | Traversing the Zona Pellucida |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 25 | HEL-S-25a | STAT5A | NM_003152.3 | GQ891302 | Acrosome | Traversing the Zona Pellucida |
| 26 | HEL-S-26a | GAS2L1 | NM_006478.3 | GQ891303 | Acrosome | Traversing the Zona Pellucida |
| 27 | HEL-S-27a | DKFZp686J1372 | BX648485.1 | GQ891304 | Acrosome | Traversing the Zona Pellucida |
| 28 | HEL-S-28a | DBI | NM_001079862.1 | GQ891305 | Acrosome | Traversing the Zona Pellucida |
| 29 | HEL-S-29a | WFDC6 | NM_080827.1 | GQ891306 | Acrosome | Traversing the Zona Pellucida |
| 30 | HEL-S-30a | NET1 | NM_001047160.1 | GQ891307 | Acrosome | Traversing the Zona Pellucida |
| 31 | HEL-S-31a | KBTBD3 | NM_152433.3 | GQ891308 | Acrosome | Traversing the Zona Pellucida |
| 32 | HEL-S-32a | LMNA | NM_005572.3 | GQ891309 | Acrosome | Traversing the Zona Pellucida |
| 33 | HEL-S-33a | LCN8 | NM_178469.3 | GQ891310 | Acrosome | Traversing the Zona Pellucida |
| 34 | HEL-S-34a | SCRN2 | NM_001145023.1 | GQ891311 | Acrosome | Traversing the Zona Pellucida |
| 35 | HEL-S-35a | KLHL15 | NM_030624.2 | GQ891312 | Acrosome | Traversing the Zona Pellucida |
| 36 | HEL-S-36a | LETMD1 | NM_001024668.1 | GQ891313 | Acrosome | Traversing the Zona Pellucida |
| 37 | HEL-S-44a | SERPINA1 | NM_000295.4 | GU727620 | Acrosome | Traversing the Zona Pellucida |
| 38 | HEL-S-184a | PFN1 | NM_005022.2 | GU727630 | Acrosome | Traversing the Zona Pellucida |
| 39 | HEL-S-185a | NMBR | NM_002511.2 | GU727635 | Acrosome | Traversing the Zona Pellucida |
| 40 | HEL-S-192a | clusterin | NM_001831.2 | GQ891391 | Acrosome | Traversing the Zona Pellucida |
| 41 | HEL-T-1a | pcmt1 | NM_005389.2 | GQ891314 | Acrosome | Traversing the Zona Pellucida |
| 42 | HEL-T-2a | BTRC | NM_003939.3 | GU727631 | Acrosome | Traversing the Zona Pellucida |
| 43 | HEL-T-3a | GNB2L1 | NM_006098.4 | GU727632 | Acrosome | Traversing the Zona Pellucida |
| 44 | HEL-T-4a | TTR | NM_000371.3 | GU727633 | Acrosome | Traversing the Zona Pellucida |
| 45 | HEL-T-5a | OFD1 | NM_003611.2 | GU727634 | Acrosome | Traversing the Zona Pellucida |
| 46 | HEL-T-6a | B4GALT3 | NM_003779.2 | GQ891315 | Acrosome | Traversing the Zona Pellucida |
| 47 | HEL-T-7e | RUFY2 | NM_001042417.1 | GU727636 | Equatorial Region | Traversing the Zona Pellucida |
| 48 | HEL-T-8e | SNAP47 | NM_053052.3 | GU727637 | Equatorial Region | Traversing the Zona Pellucida |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 49 | HEL-T-9a | FLJ00119 | AK074048 | GQ891316 | Acrosome | Traversing the Zona Pellucida |
| 50 | HEL-T-10a | RPL13A | NM_012423.2 | GQ891317 | Acrosome | Traversing the Zona Pellucida |
| 51 | HEL-T-11n | PSMA5 | NM_002790.2 | GU727639 | Neck | Traversing the Zona Pellucida |
| 52 | HEL-T-12a | ALDH1B1 | NM_000692.3 | GQ891318 | Acrosome | Traversing the Zona Pellucida |
| 53 | HEL-T-13a | PEF1 | NM_012392.2 | GQ891319 | Acrosome | Traversing the Zona Pellucida |
| 54 | HEL-T-15a | CLLD6 | NM_001127482.1 | GQ891320 | Acrosome | Traversing the Zona Pellucida |
| 55 | HTL-S-1a | AATC_HUMAN | NM_002079.2 | HM005609 | Acrosome | Traversing the Zona Pellucida |
| 56 | HTL-S-2a | PRS7_HUMAN | NM_002803.2 | HM005610 | Acrosome | Traversing the Zona Pellucida |
| 57 | HTL-S-3a | ANXA6_HUMAN | NM_001155.3 | HM005611 | Acrosome | Traversing the Zona Pellucida |
| 58 | HTL-S-4a | HSP13_HUMAN | NM_006948.4 | HM005612 | Acrosome | Traversing the Zona Pellucida |
| 59 | HTL-S-5a | INO1_HUMAN | NM_016368.3 | HM005613 | Acrosome | Traversing the Zona Pellucida |
| 60 | HTL-S-6a | KI16B_HUMAN | NM_024704.3 | HM005614 | Acrosome | Traversing the Zona Pellucida |
| 61 | HTL-S-7a | PMGE_HUMAN | NM_001724.4 | HM005615 | Acrosome | Traversing the Zona Pellucida |
| 62 | HTL-S-8a | HCDH_HUMAN | NM_005327.2 | HM005616 | Acrosome | Traversing the Zona Pellucida |
| 63 | HTL-S-9a | DAZL_HUMAN | NM_001351.2 | HM005617 | Acrosome | Traversing the Zona Pellucida |
| 64 | HTL-S-10a | TSSK6_HUMAN | NM_032037.2 | HM005618 | Acrosome | Traversing the Zona Pellucida |
| 65 | HTL-S-11a | TB182_HUMAN | NM_033396.2 | HM005619 | Acrosome | Traversing the Zona Pellucida |
| 66 | HTL-S-12a | CRLD2_HUMAN | NM_031476.3 | HM005620 | Acrosome | Traversing the Zona Pellucida |
| 67 | HTL-S-13a | GDIA_HUMAN | NM_001493.2 | HM005621 | Acrosome | Traversing the Zona Pellucida |
| 68 | HTL-S-14a | FA71A_HUMAN | NM_153606.2 | HM005622 | Acrosome | Traversing the Zona Pellucida |
| 69 | HTL-S-15a | PP1R7_HUMAN | NM_002712.1 | HM005623 | Acrosome | Traversing the Zona Pellucida |
| 70 | HTL-S-16a | KT3K_HUMAN | NM_024619.3 | HM005624 | Acrosome | Traversing the Zona Pellucida |
| 71 | HTL-S-17a | BAFL_HUMAN | NM_001014977.3 | HM005625 | Acrosome | Traversing the Zona Pellucida |
| 72 | HTL-T-1a | ATTY_HUMAN | NM_000353.2 | HM005657 | Acrosome | Traversing the Zona Pellucida |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 73 | HTL-T-2a | TMCO2_HUMAN | NM_001008740.3 | HM005658 | Acrosome | Traversing the Zona Pellucida |
| 74 | HTL-T-3a | TMCO3_HUMAN | NM_017905.4 | HM005659 | Acrosome | Traversing the Zona Pellucida |
| 75 | HTL-T-4a | UAP1_HUMAN | NM_003115.4 | HM005660 | Acrosome | Traversing the Zona Pellucida |
| 76 | HTL-T-5a | DGKQ_HUMAN | NM_001347.2 | HM005661 | Acrosome | Traversing the Zona Pellucida |
| 77 | HTL-T-6a | TKTL2_HUMAN | NM_032136.4 | HM005662 | Acrosome | Traversing the Zona Pellucida |
| 78 | HTL-T-7a | KLBL4_HUMAN | NM_001080492.1 | HM005663 | Acrosome | Traversing the Zona Pellucida |
| 79 | HTL-T-8a | MECP2_HUMAN | NM_001110792.1 | HM005664 | Acrosome | Traversing the Zona Pellucida |
| 80 | HTL-T-9a | CSN4_HUMAN | NM_016129.2 | HM005665 | Acrosome | Traversing the Zona Pellucida |
| 81 | HTL-T-10a | ACL7B_HUMAN | NM_006686.3 | HM005666 | Acrosome | Traversing the Zona Pellucida |
| 82 | HTL-T-11a | MEP50_HUMAN | NM_024102.2 | HM005667 | Acrosome | Traversing the Zona Pellucida |
| 83 | HTL-T-12a | FCL_HUMAN | NM_003313.3 | HM005668 | Acrosome | Traversing the Zona Pellucida |
| 84 | HTL-T-13a | TRXR1_HUMAN | NM_001093771.1 | HM005669 | Acrosome | Traversing the Zona Pellucida |
| 85 | HTL-T-14a | SPEF2_HUMAN | NM_024867.3 | HM005670 | Acrosome | Traversing the Zona Pellucida |
| 86 | HEL-S-153w | ORM1 | NM_000607.2 | EU794584 | the Entire Sperm | Defensin |
| 87 | HEL-S-154w | ESC42 | NM_207469.2 | EF426755 | the Entire Sperm | Defensin |
| 88 | HTL-S-44w | ROP1A_HUMAN | NM_017578.2 | HM005652 | the Entire Sperm | Defensin |
| 89 | HEL-S-45e | TEMED1 | NM_172000.3 | GQ472227 | Equatorial Region | Sperm-Egg Fusion |
| 90 | HEL-S-46e | GDI2 | NM_001115156.1 | EU794614 | Equatorial Region | Sperm-Egg Fusion |
| 91 | HEL-S-47e | ARHGDIA | NM_004309.3 | EU794615 | Equatorial Region | Sperm-Egg Fusion |
| 92 | HEL-S-48e | SPINK5L3 | NM_001040129.2 | EF426754 | Equatorial Region | Sperm-Egg Fusion |
| 93 | HEL-S-49e | ELSPBP1 | NM_022142.3 | GQ891321 | Equatorial Region | Sperm-Egg Fusion |
| 94 | HEL-S-50e | CJ081 | NM_024889.3 | FJ236306 | Equatorial Region | Sperm-Egg Fusion |
| 95 | HEL-S-51e | DKFZp686P09201 | NM_005412 | EU668344 | Equatorial Region | Sperm-Egg Fusion |
| 96 | HEL-S-52e | CAPZA2 | NM_006136.2 | GQ891322 | Equatorial Region | Sperm-Egg Fusion |
| 97 | HEL-S-53e | ALDH1A1 | NM_000689.3 | FJ224286 | Equatorial Region | Sperm-Egg Fusion |
| 98 | HEL-S-54e | Prohibitin | NM_002634.2 | FJ460516 | Equatorial Region | Sperm-Egg Fusion |
| 99 | HEL-S-55e | GLYAT | NM_005838.3 | GQ891323 | Equatorial Region | Sperm-Egg Fusion |
| 100 | HEL-S-56e | HSPA8 | NM_006597.3 | GQ891324 | Equatorial Region | Sperm-Egg Fusion |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 101 | HEL-S-57e | C3orf76 | XM_001717355.2 | GQ891325 | Equatorial Region | Sperm-Egg Fusion |
| 102 | HEL-S-60p | ADH5 | NM_000671.3 | GQ472236 | Post-acrosome | Sperm-Egg Fusion |
| 103 | HEL-S-61p | BHMT | NM_001713.2 | EU794592 | Post-acrosome | Sperm-Egg Fusion |
| 104 | HEL-S-62p | C3 | NM_000064.2 | EU794602 | Post-acrosome | Sperm-Egg Fusion |
| 105 | HEL-S-63p | GALM | NM_138801.2 | EU794611 | Post-acrosome | Sperm-Egg Fusion |
| 106 | HEL-S-64p | GSS | NM_000178.2 | EU794618 | Post-acrosome | Sperm-Egg Fusion |
| 107 | HEL-S-65p | HSP90AA1 | NM_001017963.2 | GQ472230 | Post-acrosome | Sperm-Egg Fusion |
| 108 | HEL-S-66p | PPA1 | NM_021129.3 | EU794626 | Post-acrosome | Sperm-Egg Fusion |
| 109 | HEL-S-67p | PARK7 | NM_001123377.1 | EU794641 | Post-acrosome | Sperm-Egg Fusion |
| 110 | HEL-S-68p | PGK1 | NM_000291.3 | EU794645 | Post-acrosome | Sperm-Egg Fusion |
| 111 | HEL-S-69p | PPIA | NM_021130.3 | EU794650 | Post-acrosome | Sperm-Egg Fusion |
| 112 | HEL-S-70p | ATIC | NM_004044.5 | EU794654 | Post-acrosome | Sperm-Egg Fusion |
| 113 | HEL-S-71p | TF | NM_001063.2 | GQ472199 | Post-acrosome | Sperm-Egg Fusion |
| 114 | HEL-S-72p | HSPA8 | NM_006597.3 | FJ224294 | Post-acrosome | Sperm-Egg Fusion |
| 115 | HEL-S-73p | DEFB118 | NM_054112.1 | GQ891328 | Post-acrosome | Sperm-Egg Fusion |
| 116 | HEL-S-74p | RNASE9 | NM_001001673.3 | EU414264 | Post-acrosome | Sperm-Egg Fusion |
| 117 | HEL-S-75p | GPX5 | NM_001509.2 | FJ460514 | Post-acrosome | Sperm-Egg Fusion |
| 118 | HEL-S-76p | BRF1 | NM_001519.2 | EU668327 | Post-acrosome | Sperm-Egg Fusion |
| 119 | HEL-S-77p | CSNK1G1 | NM_022048.3 | EU668329 | Post-acrosome | Sperm-Egg Fusion |
| 120 | HEL-S-78p | FGB | NM_005141.3 | EU668333 | Post-acrosome | Sperm-Egg Fusion |
| 121 | HEL-S-79p | PDE1B | NM_000924.2 | EU668337 | Post-acrosome | Sperm-Egg Fusion |
| 122 | HEL-S-80p | PPP1CB | NM_002709.2 | EU668339 | Post-acrosome | Sperm-Egg Fusion |
| 123 | HEL-S-81p | SKAP1 | NM_001075099.1 | EU668346 | Post-acrosome | Sperm-Egg Fusion |
| 124 | HEL-S-82p | TPM3 | NM_001043351.1 | EU668324 | Post-acrosome | Sperm-Egg Fusion |
| 125 | HEL-S-83p | SRPX | NM_006307.3 | EU668359 | Post-acrosome | Sperm-Egg Fusion |
| 126 | HEL-S-84p | RNASE11 | NM_145250.3 | FJ237361 | Post-acrosome | Sperm-Egg Fusion |
| 127 | HEL-S-85p | RNASE12 | NM_001024822.1 | FJ237362 | Post-acrosome | Sperm-Egg Fusion |
| 128 | HEL-S-86p | RNASE13 | NM_001012264.3 | FJ237363 | Post-acrosome | Sperm-Egg Fusion |
| 129 | HEL-S-87p | ALDOA | NM_000034.2 | FJ474908 | Post-acrosome | Sperm-Egg Fusion |
| 130 | HEL-S-88n | GLUL | NM_001033044.1 | EU668322 | Neck | Sperm-Egg Fusion |
| 131 | HEL-S-89n | HSPA5 | NM_005347.3 | EU794617 | Neck | Sperm-Egg Fusion |
| 132 | HEL-S-90n | QPRT | NM_014298.3 | EU794638 | Neck | Sperm-Egg Fusion |
| 133 | HEL-S-91n | PSMD8 | NM_002812.4 | EU668354 | Neck | Sperm-Egg Fusion |
| 134 | HEL-S-92n | APCS | NM_001639.3 | FJ460512 | Neck | Sperm-Egg Fusion |
| 135 | HEL-S-93n | PDIA3 | NM_005313.4 | FJ224330 | Neck | Sperm-Egg Fusion |
| 136 | HEL-S-94n | STIP1 | NM_003314 | FJ224350 | Neck | Sperm-Egg Fusion |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 137 | HEL-S-95n | SORD | NM_003104.4 | FJ224316 | Neck | Sperm-Egg Fusion |
| 138 | HEL-S-96n | SPAM1 | NM_003117.3 | EU794686 | Neck | Sperm-Egg Fusion |
| 139 | HEL-S-97n | PRDX4 | NM_006406.1 | FJ224297 | Neck | Sperm-Egg Fusion |
| 140 | HEL-S-98n | COMT | NM_000754.3 | FJ224345 | Neck | Sperm-Egg Fusion |
| 141 | HEL-S-99n | CALR | NM_004343.3 | FJ224311 | Neck | Sperm-Egg Fusion |
| 142 | HEL-S-100n | CCT2 | NM_006431.2 | FJ224351 | Neck | Sperm-Egg Fusion |
| 143 | HEL-S-101n | Calnexin | S67659 | GQ891329 | Neck | Sperm-Egg Fusion |
| 144 | HEL-S-102n | TCEB2 | NM_007108.2 | GQ891330 | Neck | Sperm-Egg Fusion |
| 145 | HEL-S-103n | APOH | NM_000042.2 | GQ891331 | Neck | Sperm-Egg Fusion |
| 146 | HEL-S-104n | MTHFD1 | NM_005956.3 | GQ891332 | Neck | Sperm-Egg Fusion |
| 147 | HEL-S-105n | GSTM2 | NM_000848.3 | GQ891333 | Neck | Sperm-Egg Fusion |
| 148 | HEL-S-106n | NDE1 | NM_001143979.1 | GQ891334 | Neck | Sperm-Egg Fusion |
| 149 | HEL-S-107n | MYL9 | NM_006097.3 | GQ891335 | Neck | Sperm-Egg Fusion |
| 150 | HEL-S-108n | TTC13 | NM_001122835.1 | GQ891336 | Neck | Sperm-Egg Fusion |
| 151 | HEL-S-109n | HSPA1L | NM_005527.3 | GQ891337 | Neck | Sperm-Egg Fusion |
| 152 | HEL-S-110n | ALDOC | NM_005165.2 | GQ891338 | Neck | Sperm-Egg Fusion |
| 153 | HEL-S-111n | Actin | NM_006409.2 | GQ891339 | Neck | Sperm-Egg Fusion |
| 154 | HEL-S-112n | DEFB121 | NM_001011878.1 | GQ891340 | Neck | Sperm-Egg Fusion |
| 155 | HEL-S-113n | PDRG1 | NM_030815.2 | GQ891341 | Neck | Sperm-Egg Fusion |
| 156 | HEL-S-114n | PPP4C | NM_002720.1 | GQ891342 | Neck | Sperm-Egg Fusion |
| 157 | HEL-S-115n | ITPA | NM_033453.2 | GQ891343 | Neck | Sperm-Egg Fusion |
| 158 | HEL-S-155an | BDKB | NM_001018137.1 | EU794639 | +Acrosome+ Neck | Sperm-Egg Fusion |
| 159 | HEL-S-156an | PNPH | NM_000270.2 | EU794649 | +Acrosome+ Neck | Sperm-Egg Fusion |
| 160 | HEL-S-157an | FBN1 | NM_000138.3 | GQ891350 | +Acrosome+ Neck | Sperm-Egg Fusion |
| 161 | HEL-S-186e | VDAC1 | NM_003374.1 | HM035071 | Equatorial Region | Sperm-Egg Fusion |
| 162 | HEL-S-187n | HEATR4 | NM_203309.1 | GU727638 | Neck | Sperm-Egg Fusion |
| 163 | HEL-S-188n | ACOT1 | NM_001037161.1 | GU727640 | Neck | Sperm-Egg Fusion |
| 164 | HEL-S-193e | cst8 | NM_005492.2 | GQ891394 | Equatorial Region | Sperm-Egg Fusion |
| 165 | HEL-T-16e | MUC-1 | NM_001018016.1 | GQ891326 | Equatorial Region | Sperm-Egg Fusion |
| 166 | HEL-T-21e | CYB5A | NM_001914.2 | GQ891327 | Equatorial Region | Sperm-Egg Fusion |
| 167 | HEL-T-22n | TTRAP | NM_016614.2 | GQ891344 | Neck | Sperm-Egg Fusion |
| 168 | HEL-T-23n | KLF5 | NM_001730.3 | GQ891345 | Neck | Sperm-Egg Fusion |
| 169 | HEL-T-24n | PPAPDC3 | NM_032728.3 | GQ891346 | Neck | Sperm-Egg Fusion |
| 170 | HEL-T-25n | ERLIN2 | NM_001003790.2 | GQ891347 | Neck | Sperm-Egg Fusion |
| 171 | HEL-T-26n | TAGLN2 | NM_003564.1 | GQ891348 | Neck | Sperm-Egg Fusion |
| 172 | HEL-T-27n | TBC1D13 | NM_018201.3 | GQ891349 | Neck | Sperm-Egg Fusion |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 173 | HTL-S-18e | PLCH_HUMAN | BC043358 | HM005626 | Equatorial Region | Sperm-Egg Fusion |
| 174 | HTL-S-19e | MYBPP_HUMAN | NM_032133.4 | HM005627 | Equatorial Region | Sperm-Egg Fusion |
| 175 | HTL-S-20e | BECN1_HUMAN | NM_003766.3 | HM005628 | Equatorial Region | Sperm-Egg Fusion |
| 176 | HTL-S-21e | SEHL2_HUMAN | NM_014509.3 | HM005629 | Equatorial Region | Sperm-Egg Fusion |
| 177 | HTL-S-22p | ITB5_HUMAN | NM_002213.3 | HM005630 | Post-acrosome | Sperm-Egg Fusion |
| 178 | HTL-S-23p | CAP1_HUMAN | NM_001105530.1 | HM005631 | Post-acrosome | Sperm-Egg Fusion |
| 179 | HTL-S-24p | SCAM2_HUMAN | NM_005697.3 | HM005632 | Post-acrosome | Sperm-Egg Fusion |
| 180 | HTL-S-25n | KAD2_HUMAN | NM_001625.2 | HM005633 | Neck | Sperm-Egg Fusion |
| 181 | HTL-S-26n | RANG_HUMAN | NM_002882.2 | HM005634 | Neck | Sperm-Egg Fusion |
| 182 | HTL-S-27n | TCP11_HUMAN | NM_001093728.1 | HM005635 | Neck | Sperm-Egg Fusion |
| 183 | HTL-S-28n | H1FNT_HUMAN | NM_181788.1 | HM005636 | Neck | Sperm-Egg Fusion |
| 184 | HTL-S-29n | PCTK1_HUMAN | NM_006201.3 | HM005637 | Neck | Sperm-Egg Fusion |
| 185 | HTL-S-30n | HEMK1_HUMAN | NM_016173.3 | HM005638 | Neck | Sperm-Egg Fusion |
| 186 | HTL-S-31n | RGPD5_HUMAN | NM_005054.2 | HM005639 | Neck | Sperm-Egg Fusion |
| 187 | HTL-S-32n | CALD1_HUMAN | NM_004342.5 | HM005640 | Neck | Sperm-Egg Fusion |
| 188 | HTL-S-33n | MARHA_HUMAN | NM_001100875.1 | HM005641 | Neck | Sperm-Egg Fusion |
| 189 | HTL-S-34n | CLD20_HUMAN | NM_001001346.2 | HM005642 | Neck | Sperm-Egg Fusion |
| 190 | HTL-T-15e | TMED3_HUMAN | NM_007364.2 | HM005671 | Equatorial Region | Sperm-Egg Fusion |
| 191 | HTL-T-16e | MLF1_HUMAN | NM_001130156.1 | HM005672 | Equatorial Region | Sperm-Egg Fusion |
| 192 | HTL-T-17e | BMAL1_HUMAN | NM_001030272.1 | HM005673 | Equatorial Region | Sperm-Egg Fusion |
| 193 | HTL-T-18e | ODFP2_HUMAN | NM_002540.3 | HM005674 | Equatorial Region | Sperm-Egg Fusion |
| 194 | HTL-T-19e | CAMKV_HUMAN | NM_024046.3 | HM005675 | Equatorial Region | Sperm-Egg Fusion |
| 195 | HTL-T-20e | ARPC2_HUMAN | NM_005731.2 | HM005676 | Equatorial Region | Sperm-Egg Fusion |
| 196 | HTL-T-21e | DDAH2_HUMAN | NM_013974.1 | HM005677 | Equatorial Region | Sperm-Egg Fusion |
| 197 | HTL-T-22e | TSSK1_HUMAN | NM_032028.3 | HM005678 | Equatorial Region | Sperm-Egg Fusion |
| 198 | HTL-T-23e | ZDHC2_HUMAN | BC039253 | HM005679 | Equatorial Region | Sperm-Egg Fusion |
| 199 | HTL-T-24p | POMT1_HUMAN | NM_001077365.1 | HM005680 | Post-acrosome | Sperm-Egg Fusion |
| 200 | HTL-T-25p | UGPA_HUMAN | NM_001001521.1 | HM005681 | Post-acrosome | Sperm-Egg Fusion |
| 201 | HTL-T-26n | GSTA2_HUMAN | NM_000846.4 | HM005682 | Neck | Sperm-Egg Fusion |
| 202 | HTL-T-27n | GSTM4_HUMAN | NM_000850.4 | HM005683 | Neck | Sperm-Egg Fusion |
| 203 | HTL-T-28n | GLTL5_HUMAN | NM_145292.2 | HM005684 | Neck | Sperm-Egg Fusion |
| 204 | HTL-T-29n | QSOX1_HUMAN | NM_001004128.2 | HM005685 | Neck | Sperm-Egg Fusion |
| 205 | HTL-T-30n | PTGDS_HUMAN | NM_000954.5 | HM005686 | Neck | Sperm-Egg Fusion |
| 206 | HTL-T-31n | HS74L_HUMAN | NM_014278.2 | HM005687 | Neck | Sperm-Egg Fusion |
| 207 | HTL-T-32n | CALI_HUMAN | NM_005893.2 | HM005688 | Neck | Sperm-Egg Fusion |
| 208 | HTL-T-33n | DC1I2_HUMAN | NM_001378.1 | HM005689 | Neck | Sperm-Egg Fusion |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 209 | HTL-T-34n | PP1RA_HUMAN | NM_002714.2 | HM005690 | Neck | Sperm-Egg Fusion |
| 210 | HTL-T-35n | KIF2C_HUMAN | NM_006845.3 | HM005691 | Neck | Sperm-Egg Fusion |
| 211 | HTL-T-36n | PSDE_HUMAN | NM_005805.4 | HM005692 | Neck | Sperm-Egg Fusion |
| 212 | HTL-T-37n | PEDF_HUMAN | NM_002615.4 | HM005693 | Neck | Sperm-Egg Fusion |
| 213 | HTL-T-38n | SPT18_HUMAN | NM_145263.2 | HM005694 | Neck | Sperm-Egg Fusion |
| 214 | HTL-T-39n | SNG4_HUMAN | NM_012451.2 | HM005695 | Neck | Sperm-Egg Fusion |
| 215 | HTL-T-40n | CAZA3_HUMAN | NM_033328.2 | HM005696 | Neck | Sperm-Egg Fusion |
| 216 | HTL-T-41n | ARMC4_HUMAN | NM_018076.2 | HM005697 | Neck | Sperm-Egg Fusion |
| 217 | HTL-T-42n | FBLN5_HUMAN | NM_006329.3 | HM005698 | Neck | Sperm-Egg Fusion |
| 218 | HTL-T-56A | S26A8_HUMAN | NM_052961.2 | HM005712 | Annulus | Sperm-Egg Fusion |
| 219 | HEL-S-122m | GSR | NM_000637.2 | GQ472231 | Middle Piece of Tail | Movement |
| 220 | HEL-S-123m | ATP5A1 | NM_001001937.1 | FJ224309 | Middle Piece of Tail | Movement |
| 221 | HEL-S-124m | HSPA9 | NM_004134.5 | FJ224291 | Middle Piece of Tail | Movement |
| 222 | HEL-S-125m | HSP90B1 | NM_003299.1 | FJ460515 | Middle Piece of Tail | Movement |
| 223 | HEL-S-126m | SCCPDH | NM_016002.2 | GQ891356 | Middle Piece of Tail | Movement |
| 224 | HEL-S-127m | CLDN7 | NM_001307.4 | GQ891357 | Middle Piece of Tail | Movement |
| 225 | HEL-S-128m | PRDX6 | NM_004905.2 | EU794652 | Middle Piece of Tail | Movement |
| 226 | HEL-S-129m | PSME1 | NM_006263.2 | GQ472237 | Middle Piece of Tail | Movement |
| 227 | HEL-S-130P | CATD | NM_001909.3 | EU794598 | main Piece of Tail | Movement |
| 228 | HEL-S-131P | NTN1 | NM_004822.2 | GU727649 | main Piece of Tail | Movement |
| 229 | HEL-S-132P | PHPT1 | NM_001135861.1 | EU794646 | main Piece of Tail | Movement |
| 230 | HEL-S-133P | LDHA | NM_001135239.1 | EU794632 | main Piece of Tail | Movement |
| 231 | HEL-S-134P | SELENBP1 | NM_003944.2 | EU794660 | main Piece of Tail | Movement |
| 232 | HEL-S-135P | ADAM7 | NM_003817 | GQ891358 | main Piece of Tail | Movement |
| 233 | HEL-S-136P | AKAP4 | NM_003886.2 | GQ891359 | main Piece of Tail | Movement |
| 234 | HEL-S-137P | AKAP3 | NM_006422.2 | GQ891360 | main Piece of Tail | Movement |
| 235 | HEL-S-138P | TST | NM_003312.4 | GQ891361 | main Piece of Tail | Movement |
| 236 | HEL-S-139P | GRHPR | NM_012203.1 | GQ891362 | main Piece of Tail | Movement |
| 237 | HEL-S-140P | GIPC2 | NM_017655.4 | GQ891363 | main Piece of Tail | Movement |
| 238 | HEL-S-141P | STIP1 | NM_006819.2 | GQ891364 | main Piece of Tail | Movement |
| 239 | HEL-S-142P | CAMSAP1 | NM_015447.3 | GQ891365 | main Piece of Tail | Movement |
| 240 | HEL-S-143P | ALDH2 | NM_000690.2 | GQ891366 | main Piece of Tail | Movement |
| 241 | HEL-S-144P | GNA15 | NM_002068.2 | GQ891367 | main Piece of Tail | Movement |
| 242 | HEL-S-145P | ARHGAP25 | NM_001007231.1 | GQ891368 | main Piece of Tail | Movement |
| 243 | HEL-S-146P | UGDH | NM_003359.2 | GQ891369 | main Piece of Tail | Movement |
| 244 | HEL-S-148P | WNT5A | NM_003392.3 | GQ891371 | main Piece of Tail | Movement |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 245 | HEL-S-150E | COL6A1 | NM_001848.2 | GQ891373 | End Piece of Tail | Movement |
| 246 | HEL-S-151E | COL6A2 | NM_001849.3 | GQ891374 | End Piece of Tail | Movement |
| 247 | HEL-S-165mP | AKR1A1 | NM_006066.2 | EU794588 | Tail (Middle Piece + main Piece) | Movement |
| 248 | HEL-S-166mP | AKR7A2 | NM_003689.2 | EU794591 | Tail (Middle Piece + main Piece) | Movement |
| 249 | HEL-S-167mP | CA3 | NM_005181.3 | EU794596 | Tail (Middle Piece + main Piece) | Movement |
| 250 | HEL-S-168mP | PATE3/HEL-127 | NM_001129883.3 | EF426753 | Tail (Middle Piece + main Piece) | Movement |
| 251 | HEL-S-169mP | PRKAR2A | NM_004157.2 | GQ472202 | Tail (Middle Piece + main Piece) | Movement |
| 252 | HEL-S-170mP | FAM12A | NM_006683.4 | GQ891376 | Tail (Middle Piece + main Piece) | Movement |
| 253 | HEL-S-171mP | CD52 | NM_001803.2 | FJ460513 | Tail (Middle Piece + main Piece) | Movement |
| 254 | HEL-S-172mP | ADCY8 | NM_001115.2 | GQ472223 | Tail (Middle Piece + main Piece) | Movement |
| 255 | HEL-S-173mP | ANXA1 | NM_000700.1 | GQ891377 | Tail (Middle Piece + main Piece) | Movement |
| 256 | HEL-S-174mP | ALDH4A1 | NM_003748.2 | GQ891378 | Tail (Middle Piece + main Piece) | Movement |
| 257 | HEL-S-175mP | WDR8 | NM_017818.3 | GQ891379 | Tail (Middle Piece + main Piece) | Movement |
| 258 | HEL-S-176mP | YBX2 | NM_015982.3 | GQ891380 | Tail (Middle Piece + main Piece) | Movement |
| 259 | HEL-S-177mP | ANKRD20A1 | NM_032250.3 | GQ891381 | Tail (Middle Piece + main Piece) | Movement |
| 260 | HEL-S-181mP | SAMD8 | NM_144660.1 | GQ472208 | Tail (Middle Piece + main Piece) | Movement |
| 261 | HEL-S-182mP | GNMT | NM_018960.4 | FJ224320 | Tail (Middle Piece + main Piece) | Movement |
| 262 | HEL-S-183mP | SCP2 | NM_001007098.1 | GQ891355 | Tail (Middle Piece + main Piece) | Movement |
| 263 | HEL-S-189m | DHDDS | NM_024887.2 | GU727641 | Middle Piece of Tail | Movement |
| 264 | HEL-S-190P | FLNA | NM_001110556.1 | GU727643 | main Piece of Tail | Movement |
| 265 | HEL-S-191P | EXOC3 | NM_007277.4 | GU727644 | main Piece of Tail | Movement |
| 266 | HEL-S-194m | eppin | NM_020398.2 | GQ891395 | Middle Piece of Tail | Movement |
| 267 | HEL-S-195E | HEXB_HUMAN | NM_000521.3 | GQ891410 | End Piece of Tail | Movement |
| 268 | HEL-T-14m | HADHA | NM_000182.4 | GU727642 | Middle Piece of Tail | Movement |
| 269 | HEL-T-17E | ASTN1 | NM_004319.1 | GU727645 | End Piece of Tail | Movement |
| 270 | HEL-T-18mP | GLUD1 | NM_005271.2 | GU727646 | Tail (Middle Piece + main Piece) | Movement |
| 271 | HEL-T-19mP | DGKQ | NM_001347.2 | GU727647 | Tail (Middle Piece + main Piece) | Movement |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 272 | HEL-T-20mP | PSD3 | NM_015310.3 | GU727648 | Tail (Middle Piece + main Piece) | Movement |
| 273 | HEL-T-28P | AKR7A3 | NM_012067.2 | GQ891370 | main Piece of Tail | Movement |
| 274 | HEL-T-29P | APRT | NM_000485.2 | GQ891372 | main Piece of Tail | Movement |
| 275 | HEL-T-30E | TAGLN | NM_001001522.1 | GQ891375 | End Piece of Tail | Movement |
| 276 | HEL-T-31mP | SCNN1B | NM_000336.2 | GQ891382 | Tail (Middle Piece + main Piece) | Movement |
| 277 | HEL-T-32mP | GABARAP | NM_007278.1 | GQ891383 | Tail (Middle Piece + main Piece) | Movement |
| 278 | HEL-T-33mP | ITM2B | NM_021999.4 | GQ891384 | Tail (Middle Piece + main Piece) | Movement |
| 279 | HTL-S-35m | TF2AY_HUMAN | NM_006872.2 | HM005643 | Middle Piece of Tail | Movement |
| 280 | HTL-S-36m | CSN5_HUMAN | NM_006837.2 | HM005644 | Middle Piece of Tail | Movement |
| 281 | HTL-S-37m | SPZ1_HUMAN | NM_032567.3 | HM005645 | Middle Piece of Tail | Movement |
| 282 | HTL-S-38m | F10A1_HUMAN | NM_003932.3 | HM005646 | Middle Piece of Tail | Movement |
| 283 | HTL-S-39P | LDHC_HUMAN | NM_002301.4 | HM005647 | main Piece of Tail | Movement |
| 284 | HTL-S-40P | VATE2_HUMAN | NM_080653.3 | HM005648 | main Piece of Tail | Movement |
| 285 | HTL-S-41P | DHPR_HUMAN | NM_000320.2 | HM005649 | main Piece of Tail | Movement |
| 286 | HTL-S-42E | ES1_HUMAN | NM_004649.5 | HM005650 | End Piece of Tail | Movement |
| 287 | HTL-S-43E | Q5T2B7_HUMAN | NM_003591.2 | HM005651 | End Piece of Tail | Movement |
| 288 | HTL-S-45mP | ODBB_HUMAN | NM_000056.3 | HM005653 | Tail (Middle Piece + main Piece) | Movement |
| 289 | HTL-S-46mP | STAR_HUMAN | NM_000349.2 | HM005654 | Tail (Middle Piece + main Piece) | Movement |
| 290 | HTL-S-47mP | ASGL1_HUMAN | NM_001083926.1 | HM005655 | Tail (Middle Piece + main Piece) | Movement |
| 291 | HTL-S-48mP | SPT19_HUMAN | NM_174927.1 | HM005656 | Tail (Middle Piece + main Piece) | Movement |
| 292 | HTL-T-43m | ECHD3_HUMAN | NM_024693.4 | HM005699 | Middle Piece of Tail | Movement |
| 293 | HTL-T-44m | GLPK2_HUMAN | NM_033214.2 | HM005700 | Middle Piece of Tail | Movement |
| 294 | HTL-T-45m | STK31_HUMAN | NM_001122833.1 | HM005701 | Middle Piece of Tail | Movement |
| 295 | HTL-T-46P | CLGN_HUMAN | NM_001130675.1 | HM005702 | main Piece of Tail | Movement |
| 296 | HTL-T-47P | FEZF2_HUMAN | NM_018008.3 | HM005703 | main Piece of Tail | Movement |
| 297 | HTL-T-48P | F1142_HUMAN | NM_018691.2 | HM005704 | main Piece of Tail | Movement |
| 298 | HTL-T-49P | KIF2B_HUMAN | NM_032559.4 | HM005705 | main Piece of Tail | Movement |
| 299 | HTL-T-50P | ROP1B_HUMAN | NM_001012337.1 | HM005706 | main Piece of Tail | Movement |
| 300 | HTL-T-51P | CABYR_HUMAN | NM_012189.2 | HM005707 | main section of Tail | Movement |
| 301 | HTL-T-52P | PIWL4_HUMAN | NM_152431.2 | HM005708 | main Piece of Tail | Movement |
| 302 | HTL-T-53P | HORM1_HUMAN | NM_032132.3 | HM005709 | main Piece of Tail | Movement |
| 303 | HTL-T-54P | TPD55_HUMAN | NM_001001874.1 | HM005710 | main Piece of Tail | Movement |

TABLE 2-continued

Male fertility-associated proteins located in the sperm disclosed in the invention for the first time.

| Series Number/ SEQ ID No.: | Gene Number | Corresponding Protein Names | Access Number of Reference Sequences | Access Number in the invention | Sperm Localization | Function of the protein |
|---|---|---|---|---|---|---|
| 304 | HTL-T-55E | GALC_HUMAN | NM_000153.2 | HM005711 | End Piece of Tail | Movement |
| 305 | HTL-T-57mP | AKP8L_HUMAN | NM_014371.2 | HM005713 | Tail (Middle Piece + main Piece) | Movement |
| 306 | HTL-T-58mP | CAN5_HUMAN | NM_004055.4 | HM005714 | Tail (Middle Piece + main Piece) | Movement |
| 307 | HTL-T-59mP | ADAD1_HUMAN | NM_001159285.1 | HM005715 | Tail (Middle Section + main Section) | Movement |
| 308 | HTL-T-60mP | WDR69_HUMAN | NM_178821.1 | HM005716 | Tail (Middle Section + main Section) | Movement |
| 309 | HTL-T-61mP | MATN2_HUMAN | NM_002380.3 | HM005717 | Tail (Middle Section + main Section) | Movement |
| 310 | HTL-T-62mP | PMVK_HUMAN | NM_006556.3 | HM005718 | Tail (Middle Section + main Section) | Movement |
| 311 | HTL-T-63mP | CBPC2_HUMAN | NM_024783.2 | HM005719 | Tail (Middle Section + main Section) | Movement |
| 312 | HTL-S-49mP | AK1 | NM_000476 | EU794628 | Tail (Middle Section + main Section) | Movement |
| 313 | HEL-S-158am | CTSB | NM_001908.3 | GQ891351 | Acrosome + Middle Section | Movement + Ovum Penetration |
| 314 | HEL-S-159am | CSRP1 | NM_001144773.1 | GQ891352 | Acrosome + Middle Section | Movement + Ovum Penetration |
| 315 | HEL-S-160aP | Heat shock 70 kD protein 9B | NM_004134.5 | GQ891353 | Acrosome + Main Piece of Tail | Movement + Ovum Penetration |
| 316 | HEL-S-161aP | SSX9 | NM_174962.3 | GQ891354 | Acrosome + main section of Tail | Movement + Ovum Penetration |
| 317 | HEL-S-162eP | GAPDH | NM_002046.3 | EU668321 | Equatorial Region + main section of Tail | Movement + Ovum Penetration |
| 318 | HEL-S-163pA | A1BG | NM_130786.3 | EU794585 | Post-acrosome + Annulus | Movement + Ovum Penetration |
| 319 | HEL-S-164nA | GANAB | NM_198334.1 | EU794613 | Neck + Annulus | Movement + Ovum Penetration |

* Movement Refers to Sperm Movement

Detection Method

In this invention, a detection method of male fertility-associated proteins is also provided, including (but not limited to): qualitative or quantitative detection and detection by protein chips for human sperm localization protein.

Qualitative or Quantitative Detection for Localization Protein on Human Sperm

Generally, after incubating the specific antibodies with the test sample (sperm), the sperm localization proteins are determined qualitatively or quantitatively by color indicators. A chromogenic substrate can be enzymes, chemiluminescent agents or radioisotopes, etc. The sensitivity can be greatly improved by using a second antibody to amplify the signal and highly-sensitive developing method.

The specific antibodies can be dissolved in a solution and bind to the sperm surface, thereby qualitatively or quantitatively detecting the protein level on sperm surface with detection means such as flow cytometry. The antibodies can also be fixed on the supports (e.g., polyethylene plates, immune microspheres, glass flakes, nitrocellulose (NC) membrane and PVDF film, etc.), thereby the percentage of the positive sperm can be detected qualitatively or quantitatively with an ordinary scanner.

Protein Chip and the Use Thereof in the Detection for Human Seminal Plasma

The present invention also provides protein chips used for detecting male fertility-related proteins. The chips can be used to qualitatively or quantitatively detect male fertility-related proteins in a test sample. The detection results can be used to aid the determination of the causes for certain diseases, such as male infertility. The term "protein arrays" or "protein chips" can be used interchangeably and either refers to the arrays of capture reagents which can bind to protein markers. Typically, the capture reagents can be polyclonal or monoclonal antibodies which can bind to the specific protein. In other words, any proteins, polypeptides, nucleic acids or other molecules or surfaces which can bind to the protein specifically can be used in the protein arrays. These arrays generally include hundreds or thousands of different capture reagents at the addressable sites. After the markers are labeled by detectable moleculars, the combination of the capture reagents with markers on protein arrays can be usually quantified.

The protein chips of the invention are characterized in that the detection points for male fertility-associated proteins are set on said chips and these detection points can be distributed randomly, or in different detection regions on the chip, or relatively centralize in one or several specific detection zones on the chip.

As used herein, the term "detection point" refers to the spotting point used for detecting the corresponding protein on a protein chip. For example, the detection point used for detecting Protein HEL-75 is generally formed by spotting In a preferred embodiment, the protein chip contains regions corresponding to the various phases of sperm maturation or regions for evaluating different functions. For example, it comprises one or more detection zones selected from the group consisting of detection zones for sperm capacitation, detection zones for sperm motility related proteins, and detection zones for sperm penetration related proteins, thereby detecting male fertility-associated proteins with different functions or types more conveniently. It should be appreciated that said detection zones can be centralized areas physically. For example, a chip can be divided into different detection zones A, B, and C, wherein The protein chips suitable for the present invention are not particularly limited. Any blank protein chips with known structures in the art can be used. Generally, supports for these protein chips include: immune microspheres, glass sheets, plastic sheets, nitrocellulose (NC) film, and PVDF film, in which the immune microspheres and various substrates are particularly preferred. The purpose for detecting various proteins can be achieved by orderly fixing peptides, proteins or antibodies on various supports through the methods such as in-situ synthesis, mechanical spotting or covalent binding to form the chip for detection, fluorescence-marked antibodies or other components interacting with the chip, washing off the components which fail to bind to the complementary proteins on the chip by rinsing, and then using a fluorescence scanner or a confocal laser scanning technology to detect the fluorescence intensity of each point on the chip or other supports and the strength of markers for analyzing the content of each protein.

Protein chip of the invention may comprise detection points for one or more, preferably ≥5, more preferably ≥10, most preferably ≥20 male fertility-associated proteins disclosed for the first time in the invention. For instance, it comprises detection points for at least 5, 10, 15, 20, 25, 30, 40, 50, 60, 70, 80, 90, 100, 150, 200, 250, 300, or up to all (305 or more) of the proteins according to the invention.

As described above, the protein chip of the invention preferably comprises relatively independent detection zones. When it comprises one or more of such detection zones, each detection zone preferably contains detection points for at least 2, preferably at least 5 of the proteins according to the invention.

TABLE 3

| Detection Zones | Proteins according to the invention | The Known Proteins | Numbers of Detection Points |
| --- | --- | --- | --- |
| Zona Penetration Zones | Protein Numbers in Table 2: 1, 2, 5-39, 41-85, 313-319 | None | ≥2, ≥5, ≥10 Detection Points |
| Sperm-egg Fusion Associated | Protein Numbers in Table 2: 89-92, 94-116, 118-130, 132-137, 139-163, 165-218, 313-319 | Protein Numbers in Table1: K6-K13 | ≥2, ≥5, ≥10 Detection Points |
| Sperm Movement Associated | Protein Numbers in Table 2: 219-231, 233-251, 254-265, 268-312, 313-319 | Protein Numbers in Table1: K1-K5 | ≥2, ≥5, ≥10 Detection Points |
| Sperm Protection Associated | Protein Numbers in Table 2: 86, 88 | Protein Numbers in Table1: K14 | ≥1, ≥2, or ≥3 Detection Points | detection zone A can be the detection zone for sperm capacitation, detection zone B can be the detection zone for sperm motility related proteins, and detection zone C can be the detection zone for sperm penetration related proteins. Alternatively, said detection zones may not centralize physically, but processed by classification during the data analysis or process, thereby constituting a specific detection zone such as sperm capacitation detection zone, etc. For instance, if several detection points randomly arranged on the chip are processed by classification as the detection zone for sperm capacitation during the data analysis or process, said detection zone for sperm capacitation could be considered as being present on the protein chip. If certain male fertility protein A involves a variety of functions, such mode facilitates to avoid repeated spotting of the protein A on the chip, that is, only one detection point for protein A is needed and it is not necessary to set multiple detection zones and set detection points for protein A in each zone.

It should be understood that the protein chip of the invention can be used to comprehensively detecting all or most of the male fertility—associated proteins, or to detect certain male fertility-associated protein with special functions. For example, it merely contains the detection points for sperm capacitation, or the most concerned pathogenic proteins of the invention (which cause most infertility cases).

In a preferred embodiment, the protein chip for immunological analysis and the preparation method thereof are provided. A high-speed automatic spotting robot can be used to spot the protein samples (antibodies to the proteins of the invention) on the chemically processed slides. Proteins are fixed by chemical bonds with the microscope slides (e.g. by a covalent bond formed between aldehyde group on the surface of slide and amino group). The spotting array of said protein sample is designed as a square one. Protein samples are spotted over each array. The process of analysis is integrated on the surface of the chip and the molecules in the protein samples are marked with fluorescent markers. Finally, the fluorescence scanning analysis system for chips is used to detect and analyze the protein samples.

INDUSTRIAL APPLICATIONS

Based on the present invention, detection method and instruments for male fertility-associated proteins can be used to detect the content of the fertility-associated proteins in seminal plasma of infertile patients.

The advantages of the invention mainly include:

(a) The qualitative or quantitative results of multiple proteins which are associated with male fertility in an individual can be screened quickly and efficiently.

(b) It can be used for scientific research, especially for the research of reproduction-associated field.

The present invention will be further illustrated below with reference to specific examples. It should be understood that these examples are only to illustrate the present invention but not to limit the scope of the present invention. The experimental methods with no specific conditions described in the following examples are generally performed under conventional conditions, such as the conditions described in Sambrook et al, molecular cloning: the Laboratory manual (New York: Cold Spring Harbor Laboratory Press, 1989), or according to the manufacture's instruction.

Example 1

Epididymal and testicular samples were taken from young males (27-30 years old) of accidental death with childbearing history, and without the record of reproductive system diseases. The protocols of body donation to medical research were signed with their families, and meanwhile, were approved by the Ethics Committee of Yantai Yuhuangding Hospital. After the samples have been obtained by surgery, protein samples were extracted immediately from the epididymal luminal fluid and testicular tissue and the proteins were quantified. Equivalent samples from more than three individuals were mixed, and the two-dimensional gel electrophoresis separation was performed. The common proteins from the three repeated electrophoresis were characterized by mass spectrometry, wherein the number of proteins with clear localization in sperms was 319.

Example 2 Sperm Preparation

Normal semen was liquefied for 30 min at 37° C., and 1.0 ml of semen was transferred into Earle's solution equilibrated for 12 h under 37° C., 5% $CO_2$ and saturated humidity. The tube was tilted for about 45° and incubated for 60 min for the sperms with better activity substantially going upward, and the tube was centrifuged at 600 g for 10 min. The supernatant was discarded and the precipitate was washed twice for use. The normal semen was provided by Yantai Yuhuangding Hospital Reproductive Center with the consent of the donors.

Example 3 Expression Vector Construction and Protein Purification

Protein products of 319 genes said above were obtained by the following method. According to the gene sequence, a pair of specific primers was synthesized to amplify the mature coding regions. cDNA library of human epididymis prepared by a routine method was used as templates, and the target genes were directly amplified by PCR. Then the target genes were cloned to commercially available pGM-T vector (purchased from Shanghai BestBio Corporation) and sequenced to be correct. The sequenced genes were cloned to the expression vector pET32b (+) (purchased from Shanghai BestBio Corporation) through the enzyme cleavage sites, and kept consistent with the ORF of the fusion tag. The recombinant expression vectors were transferred into the competent cell of a routine E. coli BL21 (DE3) and the engineered bacteria were obtained. After being expressed by induction using 1 mM IPTG at 32° C., the recombinant proteins were separated and purified by a "two-step nickel affinity chromatography" according to His-Tag of the vector. (FIG. 1) Upon purification, the recombinant proteins were quantified by Bradford (Bradford 1976) method and lyophilized for storing.

Example 4 Preparation and Activity Test for Monoclonal Antibodies

The monoclonal antibodies against the above 319 proteins were obtained by the following method. The recombinant proteins prepared in Example 1 were used to immunize BALB/C mice. Briefly, each mouse was injected on the first day with 50 μg of recombinant protein and the same amount of Complete Freund's Adjuvant (CFA). Then, 25 μg of recombinant protein and the same amount of Incomplete Freund's Adjuvant (IFA) were injected on the 15th, 30th and 45th days for booster immunization. 3 to 4 days after the last immunization, spleen cells were separated and mixed with Sp2 myeloma cell strains, and PEG was added for cell fusion to obtain fused cells. The fused cells were diluted properly and respectively placed into well plate for culture. Generally, they were diluted to 0.8 cells/well. When the cells had been grown to 20% of confluence, the supernatant was taken and detected for the screening antibodies by ELISA. Screened positive cells were inoculated intraperitoneally into mice, and then the ascites was collected. The ascites were loaded to an affinity column prepared by using staphylococcal protein A and were eluted, thereby the monoclonal antibodies are recovered.

Example 5 Immunofluorescence Localization of the Three Representative Proteins: Protein HEL-S-65P, HEL-S-154w, HEL-S-6a Sperms were collected, washed with PBS, and then plated on slides coated with 1% gelatin. The slides were fixed for 10 minutes with methanol after natural drying. Slides with sperm were blocked for 1 hour at room temperature with 3% BSA, and then the monoclonal antibodies for each protein (1:200) were added and kept overnight at 4° C. The slides were washed for three times with PBST (PBS containing 0.1% Tween-20), and the corresponding secondary antibodies (1:200) of FITC-labeled goat anti-mouse IgG were added. The slides were washed for three times with PBST, and 80% glycerol was used for blocking. Olympus BX-52 microscope was used to observe the results.

Figure 3:
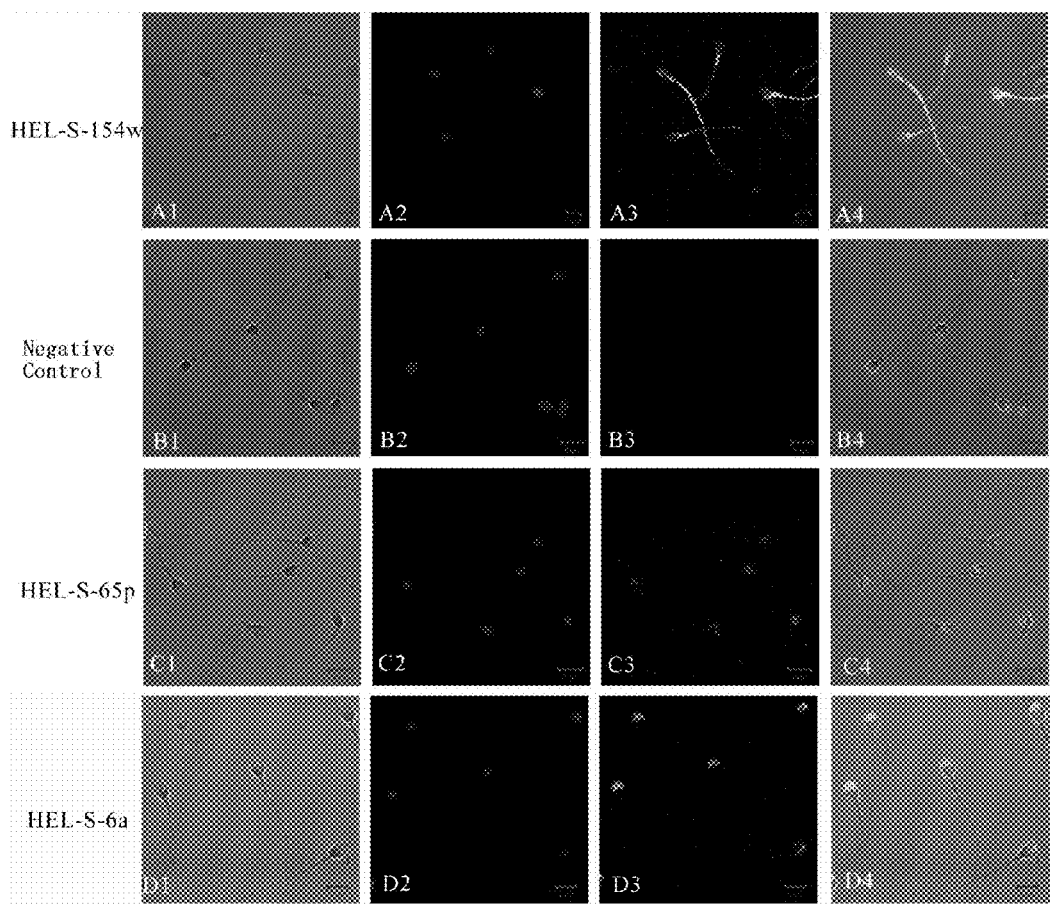
FIG. 3 shows that Protein HEL-S-154w, HEL-S-65p, and HEL-S-6a are localized in the whole body, tail and acrosome of sperms respectively, through the immunofluorescence localization for sperms.

FIG. 3 shows the results that Protein HEL-S-65p, HEL-S-154w, and HEL-S-6a bind to the tail, the entire body, and acrosome of the sperm respectively.

Example 6 Effect on Sperm Movement of Protein HEL-S-65p

Into three 0.5 ml sterile centrifuge tubes, 100 μl sperm suspension with an adjusted concentration ($2.0 \times 10^7$/ml) was added respectively, and the tubes were labeled as control group, experimental group and positive control group respectively. The tubes were placed tilted in an incubator under 5% $CO_2$ and saturated humidity at 37° C., and incubated for 3 hours for capacitation. After capacitation, into the control group, merely 2 µl of cultural solution for sperm capacitation (BWW) was added, and 2 µl of antibody to Protein (1:200) HEL-S-65p was added into the experimental group, while 2 µl of antibody to HEL-75 was added into the positive control group and mixed. The sperms were incubated for another 1 hour in the incubator for sperm blocking.

Motility detection was performed to the sperm prepared as above. Hamilton sperm motility analyzer was used as the detection equipment. The depth of chamber for samples is 20 µm. The experimental results are listed in Table A.

Table A shows the immunofluorescence localization of Protein HEL-S-65p and its effect on sperm motility. Immunofluorescence localization of sperm indicates that Protein HEL-S-65p is located in the main Piece of the sperm tail. Motility parameters of sperms are significantly inhibited after being blocked by the antibodies.

TABLE A

Motility Data for Sperms Capacitated and Blocked

| Parameter | Control Group (n = 3) | HEL-S-65p (n = 3) |
|---|---|---|
| Percentage of moving sperm (%) | 65.67 ± 13.01 | 13.00 ± 7.55 (P = 0.047) |
| Percentage of sperm moving forward (%) | 44.00 ± 11.53 | 2.67 ± 2.52 (P = 0.036) |
| VAP(µm/s) | 65.03 ± 4.92 | 21.33 ± 7.85 (P = 0.002) |
| VSL(µm/s) | 53.93 ± 6.18 | 15.37 ± 0.83 (P = 0.007) |
| VCL(µm/s) | 132.06 ± 6.86 | 50.17 ± 13.45 (P = 0.006) |
| ALH(µm) | 6.57 ± 0.40 | 2.73 ± 0.64 (P = 0.023) |
| BCF(HZ) | 29.23 ± 1.45 | 18.3 ± 2.74 (P = 0.029) |

Example 7 Antibacterial Activity of Protein HEL_S_154w

Figure 4:
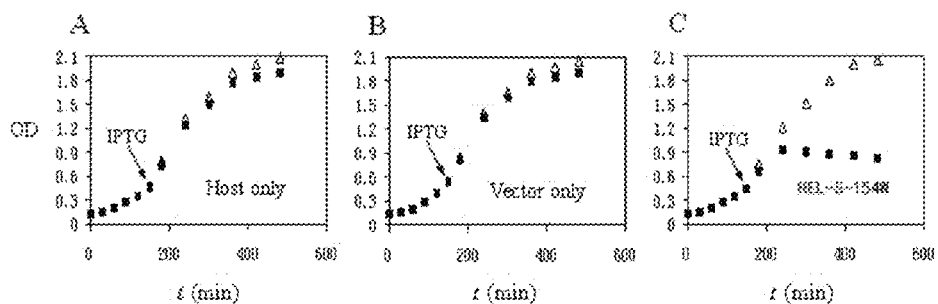
FIG. 4 shows the significant bacteriostatic activity of Protein HEL-S-154W.

The bacteria (*E. coli* BL21) transferred with recombinant vector pET-32b (+)-HEL-S-154w or empty vector pET-32b (+) were cultured overnight, and then inoculated on LB medium as 1:40. Samples were taken for OD600 determination at that time, and then samples were taken every other 1 h. When the exponential growth phase arrived, the bacteria were divided into 2 aliquots. IPTG was added into one of them to a final concentration of 0.1 mM, and the other was blank for control. And then OD600 was determined in triplicate every other 1 h. The blank host bacterium of BL21, as the negative control group, was used to detect the toxicity of IPTG. (Shown in FIG. 4).

Example 8 Antibacterial Activity of Protein HEL-S-154W

*E. coli* XL-1 blue was cultured overnight to log phase ($OD_{600}$=0.4~0.5), and then diluted with 10 mM PBS (pH 7.4). Bacteria of about $2\times10^6$ CFU/ml were mixed with 12.5~100 ug/ml rRNASE9 and cultured at 37° C. Samples were taken at 15, 30, 60 and 120 minutes after the culture had been started. The samples were diluted successively with 10 mM PBS. 100 ul of each dilution was taken and plated, and cultured overnight at 37° C. for forming single colonies. The number of colonies was counted and the antibacterial activity was represented by the percentage of bacterial survival. The formula is: % survival=(the number of surviving colonies treated by the protein/the number of surviving colonies without being treated by the protein)*100.

Figure 5:
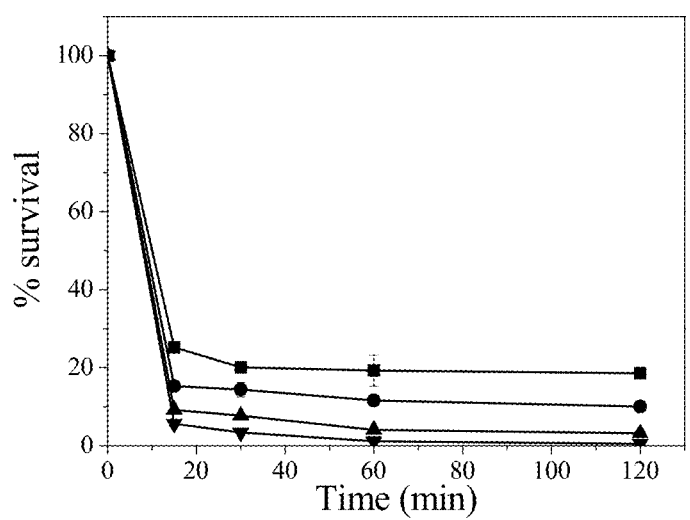
FIG. 5 shows the antibiotic activity of Protein HEL-S-154W.

Results are shown in FIG. 5, indicating that Protein HEL-S-154W has antibacterial activity.

Example 9 Experiments for Ovum Penetration of Protein HEL_S_6a

Into three 0.5 ml sterile centrifuge tubes, 100 µl sperm suspension with an adjusted concentration above was added respectively, and the tubes were labeled as control group, experimental group and positive control group respectively. Into the control group, merely 2 µl BWW solution was added and 2 µl antibodies to Protein HEL-S-6a (1:200) was added into the experimental group, while 2 µl antibodies to HEL-75 was added into the positive control group and mixed. The tubes were placed tilted in an incubator under 5% $CO_2$ and saturated humidity at 37° C., and incubated for 3 hours for blockage and capacitation. The sperm suspension was taken and centrifuged at 600 g for 10 min. The supernatant was discarded for removing the excess primary antibody added. Then, BWW solution was used to regulate sperm concentration to about $3.5\times10^6$/ml. Three groups of 90 µl of sperm suspension were taken, and 10 µl of 100 µmol/L progesterone was added respectively to the final progesterone concentration at 10 µl/L for inducing the acrosome reaction of the capacitated sperms. 35 mm sterile plastic Petri dish was used and the sperm suspension induced for acrosome reaction was prepared into 100 µl fertilized drops into which 15-20 oocytes were added respectively. The dish was covered with paraffin oil, and incubated for 3 h in a carbon dioxide incubator under 6% $CO_2$ and saturated humidity at 37° C. for fertilization. Upon fertilization, the oocytes were taken out and the dispersed sperms on the surface of oocyte were washed off with BWW. The coverslip was put on the dish and the zygotes were observed with a phase contrast microscope. The presence of bulged sperm head and its tail or male pronuclear are considered as an indicator of ovum penetration. Percentage of the sperms penetrating into ovum was counted. The experimental results are shown in Table B.

Table B shows the immunofluorescence localization and activity of ovum penetration of Protein HEL-S-6a. Sperm immunofluorescence localization shows that Protein HEL-S-6a is localized in the sperm acrosome and the antibody thereof can significantly inhibit the ability of sperms to penetrate ovum pre- and post-capacitation.

TABLE B

Experiment of ovum penetration

| | Control Group (n = 3) | HEL-S-6a (n = 3) |
|---|---|---|
| SPA(pre-capacitation) | 69.83 ± 9.83 | 22.67 ± 10.41 (P = 0.035) |
| SPA(post-capacitation) | 71.67 ± 7.02 | 26.87 ± 1.80 (P = 0.01) |

Example 10 Preparation of the Protein Chips

Protein chips No. 1-4 were prepared with following method:
 (a) Slide Chip
 (1) a high-speed spotting instrument was used for directly and highly densely spotting the protein samples (antibodies to the proteins of the invention) in the multi-well plate on the slides which have been chemically treated and have activated aldehyde groups on the surface. There are 16 (4×4) sample spots for each array, and the diameter of each sample spot is 0.4 mm;

(2) incubating the slides at room temperature overnight or at 37° C. for 1 hour for fixing the sample through the condensation reaction between the amino groups on the protein and the aldehyde groups on the slide;

(3) activated aldehyde groups not occupied by the proteins on slides were reduced and the slides were washed thoroughly and dried at the room temperature;

(4) finally, the slides were sealed with photophobic materials and stored under 4° C.

(b) PDVF Film Chip (1) a high-speed spotting instrument was used for spotting the protein samples (antibodies to the proteins of the invention) in the multi-well plate on the PDVF film. There are 16 (4×4) sample spots for each array, and the diameter of each sample spot is 0.4 mm;

(2) the film was washed for 2-3 times with buffer solution, 3-6 minutes for each time;

(3) 5% calf serum or skimmed milk powder was used for blockage for 1-2 hour at a room temperature.

(4) the film was washed for 2-3 times with buffer solution again, 3-6 minutes for each time;

(5) the film was dried, sealed with photophobic materials and stored under 4° C.

Wherein, detection points comprised in chips are shown in Table C as followed:

Example 11 Applications of Protein Chips

Chip No. 4 prepared in Example 10 was used to detect the content of male fertility-associated proteins in the seminal plasma from 21 male infertile patients. The detection results indicated that the seminal plasma from five cases of asthenospermia patients lacks Protein HEL-S-162eP.

Sperm motility detection was performed to the sperms lacking Protein HEL-S-162eP from the five cases of asthenospermia patient which. The result showed that sperm motility of these 5 male infertile patients was very weak (lower than 30% of that for the normal control). Furthermore, sperm immunofluorescence experiments showed that the localization of Protein HEL-S_162eP on the sperm surface is weak or absent.

The experiment for sperm localization of Protein HEL-S-162 indicates that Protein HEL-S 162eP locates in the equatorial region+main piece of tail (Shown in Table 2), suggesting that it could be relevant to sperm motility.

On the whole, the above detection results suggest that lacking of Protein HEL-S-162 eP is the main reason for male infertility.

DISCUSSION

At present, a few seminoproteins have been clinically used in the adjuvant diagnosis and treatment of infertility. A combined detection for multiple markers can be used to screening and improve the positive rate of diagnosis. Commonly used immunological detection methods include radioimmunoassay (RIA), Enzyme Linked Immunosorbent

TABLE C

| Chip No. | Type of Substrate | Detection Zones | Detection Points |
|---|---|---|---|
| 1 | Slides | 3 Detection Zones: | 214 detection points were set in detection zones of proteins associated with ovum penetration, and the antibodies correspond to the protein, the numbers of which are listed in Table 2: 1, 2, 5-39, 41-85, 89-92, 94-116, 118-130, 132-137, 139-163, 165-218, 313-319; 96 detection points were set in detection zones of proteins associated with sperm motility, and the antibodies correspond to the protein, the numbers of which are listed in Table 2: 219-231, 233-251, 254-265, 268-312, 313-319; 2 detection points were set in detection zones of proteins associated with sperm protection, and the antibodies correspond to the protein, the numbers of which are listed in Table 2: 86, 88; |
| 2 | PDVF film | 3 Detection Zones: | 214 detection points were set in detection zones of proteins associated with ovum penetration, and the antibodies correspond to the protein, the numbers of which are listed in Table 2: 1, 2, 5-39, 41-85, 89-92, 94-116, 118-130, 132-137, 139-163, 165-218, 313-319; 96 detection points were set in detection zones of proteins associated with sperm motility, and the antibodies correspond to the protein, the numbers of which are listed in Table 2: 219-231, 233-251, 254-265, 268-312, 313-319; 2 detection points were set in detection zones of proteins associated with sperm protection, and the antibodies correspond to the protein, the numbers of which are listed in Table 2: 86, 88; |
| 3 | PDVF film | 1 Detection Zone: | merely comprises the detection zones associated with sperm motility in chip 1 |
| 4 | PVDF film | 1 Detection Zone: | comprises all of 305 proteins in Table 2 but not in Table 1 |

Assay (ELISA), chemiluminescence immunoassay (CLIA). The above methods have their own advantages, however, a common limitation existed in these techniques, that is, only one infertility protein marker can be detected for each time. Obviously, it can not meet the clinical requirement for the combined detection for multiple infertility markers. Protein chips can detect different target proteins in the same sample simultaneously, and they can detect multiple samples simultaneously as well, thereby, greatly improving the efficiency, possessing excellent sensitivity, accuracy and signal-noise ratio. For the present invention, merely traces of samples are required and the method according to the present invention is readily to be operated and possesses good repeatability.

305 human sperm localization proteins are selected in the invention, which are essential to the sperm maturation. They can be used as markers for the development of kits development, or used in the male infertility research and as diagnostic reagents of clinical routine examination.

All literatures mentioned in the present application are incorporated by reference herein, as though individually incorporated by reference. Additionally, it should be understood that after reading the above teaching, many variations and modifications may be made by the skilled in the art, and these equivalents also fall within the scope as defined by the appended claims.

SEQUENCE LISTING (319 sequences)

SEQ ID NO: 1 - protein, 312 aa, Homo sapiens
MEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 2 - protein, 198 aa, Homo sapiens
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGGLGPLNIPLLADVTRRLSEDYGVLKTDEGIAYRGLFIIDGKGVLRQITVNDLPVGRSVDEALRLVQAFQYTDEHGEVCPAGWKPGSDTIKPNVDDSKEYFSKHN

SEQ ID NO: 3 - protein, 163 aa, Homo sapiens
MGGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 4 - protein, 244 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 5 - protein, 840 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 6 - protein, 148 aa, Homo sapiens
MTKALLIYLVSSFLALNQASLISRCDLAQVLQLEDLDGFEGYSLSDWLCLAFVESKFNISKINENADGSFDYGLFQINSHYWCNDYKSYSENLCHVDCQDLLNPNLLAGIHCAKRIVSGARGMNNWVEWRLHCSGRPLFYWLTGCRLR

SEQ ID NO: 7 - protein, 1610 aa, Homo sapiens
MNTPKEEFQDWPIVRIAAHLPDLIVYGHFSPERPFMDYFDGVLMFVDISGFTAMTEKFSSAMYMDRGAEQLVEILNYHISAIVEKVLIFGGDILKFAGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 8 - protein, 276 aa, Homo sapiens
MTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGCQLLVYPGAFNLTTGPAHWELLQRSRAVDNQVYVATASPARDDKASYVAWGHSTVVNPWGEVLAKAGTEEAIVYSDIDLKKLAEIRQQIPVFRQKRSDLYAVEMKKP

SEQ ID NO: 9 - protein, 600 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQGDPRTTSRGCYVM

SEQ ID NO: 10 - protein, 172 aa, Homo sapiens
MLAAGVGGQGERLAGRRRKMAVESRVTQEEIKKEPEKPIDREKTCPLLLRVFTTNNGRHHRMDEFSRGNVPSSELQIYTWMDATLKELTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 11 - protein, 744 aa, Homo sapiens
MAGRSMQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQFNNQAFSVGQQLVFSFNEKLFGLLVKDIEAMDPSILKGEPATGKRQKIEVGLVVGNSQVAFEKAENSSLNLIGKAKTKENRQSIINPDWNFEKMGIGGLDKEFSDIFRRAFASRVFPPEIVEQMGCKHVKGILLYGPPGCGKTLLARQIGKMLNAREPKVVNGPEILNKYVGESEANIRKLFADAEEEQRRLGANSGLHIIIFDEIDAICKQRGSMAGSTGVHDTVVNQLLSKIDGVEQLNNILVIGMTNRPDLIDEALLRPGRLEVKMEIGLPDEKGRLQILHIHTARMRGHQLLSADVDIKELAVETKNFSGAELEGLVRAAQSTAMNRHIKASTKVEVDMEKAESLQVTRGDFLASLENDIKPAFGTNQEDYASYIMNGIIKWGDPVTRVLDDGELLVQQTKNSDRTPLVSVLLEGPPHSGKTALAAKIAEESNFPFIKICSPDKMIGFSETAKCQAMKKIFDDAYKSQLSCVVVDDIERLLDYVPIGPRFSNLVLQALLVLLKKAPPQGRKLLIIGTTSRKDVLQEMEMLNAFSTTIHVPNIATGEQLLEALELLGNFKDKERTTIAQQVKGKKVWIGIKKLLMLIEMSLQMDPEYRVRKFLALLREEGASPLDFD

SEQ ID NO: 12 - protein, 470 aa, Homo sapiens
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 13 - protein, 194 aa, Homo sapiens
MEEKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 14 - protein, 302 aa, Homo sapiens
MALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 15 - protein, 803 aa, Homo sapiens
MITLTELKCLADAQSSYHILKPWWDVFWYYITLIMLLVAVLAGALQLTQSRVLCCLPCKVEFDNHCAVPWDILKASMNTSSNPGTPLPLPLRIQNDLHRQQYSYIDAVCYEKQLHWFAKFFPYLVLLHTLIFAACSNFWLHYPSTSSRLEHFVAILHKCFDSPWTTRALSETVAEQSVRPLKLSKSKILLSSSGCSADIDSGKQSLPYPQPGLESAGIESPTSSVLDKKEGEQAKAIFEKVKRFRMHVEQKDIIYRVYLKQIIVKVILFVLIITYVPYFLTHITLEIDCSVDVQAFTGYKRYQCVYSLAEIFKVLASFYVILVILYGLTSSYSLWWMLRSSLKQYSFEALREKSNYSDIPDVKNDFAFILHLADQYDPLYSKRFSIFLSEVSENKLKQINLNNEWTVEKLKSKLVKNAQDKIELHLFMLNGLPDNVFELTEMEVLSLELIPEVKLPSAVSQLVNLKELRVYHSSLVVDHPALAFLEENLKILRLKFTEMGKIPRWVFHLKNLKELYLSGCVLPEQLSTMQLEGFQDLKNLRTLYLKSSLSRIPQVVTDLLPSLQKLSLDNEGSKLVVLNNLKKMVNLKSLELISCDLERIPHSIFSLNNLHELDLRENNLKTVEEIISFQHLQNLSCLKLWHNNIAYIPAQIGALSNLEQLSLDHNNIENLPLQLFLCTKLHYLDLSYNHLTFIPEEIQYLSNLQYFAVTNNNIEMLPDGLFQCKKLQCLLLGKNSLMNLSPHVGELSNLTHLELIGNYLETLPPELEGCQSLKRNCLIVEENLLNTLPLPVTERLQTCLDKC

SEQ ID NO: 16 - protein, 723 aa, Homo sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 17 - protein, 349 aa, Homo sapiens
MASKKVCIVGSGNWGSAIAKIVGGNAAQLAQFDPRVTMWVFEEDIGGKKLTEIINTQHENVKYLPGHKLPPNVVAVPDVVQAAEDADILIFVVPHQFIGKICDQLKGHLKANATGISLIKGVDEGPNGLKLISEVIGERLGIPMSVLMGANIASEVADEKFCETTIGCKDPAQGQLLKELMQTPNFRITVVQEVDTVEICGALKNVVAVGAGFCDGLGFGDNTKAAVIRLGLMEMIAFAKLFCSGPVSSATFLESCGVADLITTCYGGRNRKVAEAFARTGKSIEQLEKELLNGQKLQGPETARELYSILQHKGLVDKFPLFMAVYKVCYEGQPVGEFIHCLQNHPEHM

SEQ ID NO: 18 - protein, 339 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 19 - protein, 558 aa, Homo sapiens
MELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCSRKVSRKSSSSRTPLTHALPGLSEQEGQKTSAASCPQPPTFLLPLLLFLALTVARPRWR

SEQ ID NO: 20 - protein, 218 aa, Homo sapiens
MPMTLGYWDIRGLAHAIRLLLEYTDSSYVEKKYTLGDAPDYDRSQWLNEKFKLGLDFPNLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEGLKKISAYMKSSQFLRGLLFGKSATWNSK

SEQ ID NO: 21 - protein, 337 aa, Homo sapiens
MADAAPQLGKRKRELDVEEAHAASTEEKEAGVGNGTCAPVRLPFSGFRLQKVLRESARDKIIFLHGKVNEASGDGDGEDAVVILEKTPFQVEQVAQLLTGSPELQLQFSNDIYSTYHLFPPRQLNDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 22 - protein, 294 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 23 - protein, 697 aa, Homo sapiens
MGERAGSPGTDQERKAGKHHYSYLSDFETPQSSGRSSLVSSSPASVRRKNPKRQTSDGQVHHQAPRKPSPKGLPNRKGVRVGFRSQSLNREPLRKDTDLVTKRILSARLLKINELQNEVSELQVKLAELLKENKSLKRLQYRQEKALNKFEDAENEISQLIFRHNNEITALKERLRKSQEKERATEKRVKDTESELFRTKFSLQKLKEISEARHLPERDDLAKKLVSAELKLDDTERRIKELSKNLELSTNSFQRQLLAERKRAYEAHDENKVLQKEVQRLYHKLKEKERELDIKNIYSNRLPKSSPNKEKELALRKNAACQSDFADLCTKGVQTMEDFKPEEYPLTPETIMCYENKWEEPGHLTLDLQSQKQDRHGEAGILNPIMEREEKFVTDEELHVVKQEVEKLEDEWEREELDKKQKEKASLLEREEKPEWETGRYQLGMYPIQNMDKLQGEEEERLKREMLLAKLNEIDRELQDSRNLKYPVLPLLPDFESKLHSPERSPKTYRFSESSERLFNGHHLQDISFSTPKGEGQNSGNVRSPASPNEFAFGSYVPSFAKTSERSNPFSQKSSFLDFQRNSMEKLSKDGVDLITRKEKKANLMEQLFGASGSSTISSKSSDPNSVASSKGDIDPLNFLPGNKGSRDQEHDEDEGFFLSEGRSFNPNRHRLKHADDKPAVKAADSVEDEIEEVALR

SEQ ID NO: 24 - protein, 215 aa, Homo sapiens
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 25 - protein, 794 aa, Homo sapiens
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 26 - protein, 681 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRPRDQLPPHPRSRRYSGDSDSSASSAQSGPLGTRSDDTGTGPRRERPSRRLTTGTPASPRRPPALRSQSRDRLDRGRPRGAPGGRGAQLSVPSPARRARSQSREEQAVLLVRRDRDGQHSWVPRGRGSGGSGRSTPQTPRARSPAAPRLSRVSSPSPELGTTPASIFRTPLQLDPQQEQQLFRRLEEEFLANARALEAVASVTPTGPAPDPARAPDPPAPDSAYCSSSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 27 - protein, 232 aa, Homo sapiens
MAGITTIEAVKRKIQVLQQQADDAEERAERLQREVEGERRAREQAEAEVASLNRRIQLVEEELDRAQERLATALQKLEEAEKAADEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 28 - protein, 87 aa, Homo sapiens
MSQAEFEKAAEEVRHLKTKPSDEEMLFIYGHYKQATVGDINTERPGMLDFTGKAKWDAWNELKGTSKEDAMKAYINKVEELKKKYGI

SEQ ID NO: 29 - protein, 86 aa, Homo sapiens
MGLSGLLPILVPFILLGDIQEPGHAEGILGKPCPKIKVECEVEEIDQCTKPRDCPENMKCCPFSRGKKCLDFRKVSLTLYHKEELE

SEQ ID NO: 30 - protein, 596 aa, Homo sapiens
MEPELAAQKQPRPRRRSRRASGLSTEGATGPSADTSGSELDGRCSLRRGSSFTFLTPGPNWDFTLKRKRREKDDDVVSLSSLDLKEPSNKRVRPLARVTSLANLISPVRNGAVRRFGQTIQSFTLRGDHRSPASAQKFSSRSTVPTPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKAKNIFRIRFHDPSPAQSHTLQANDVFHKQQWFNCIRAAIAPFQSAGSPPELQGLPELHEECEGNHPSARKLTAQRRASTVSSVTQVEVDENAYRCGSGMQMAEDSKSLKTHQTQPGIRRARDKALSGGKRKETLV

SEQ ID NO: 31 - protein, 612 aa, Homo sapiens
MELAMDNSYAFNQRSTCNGIPSEKKNNFLVSEDHGQKILSVLQNFREQNVFYDFKIIMKDEIIPCHRCVLAACSDFFRAMFEVNMKERDDGSVTITNLSSKAVKAFLDYAYTGKTKITDDNVEMFFQLSSFLQVSFLSKACSDFLIKSINLVNCLQLLSISDSYGSTSLFDHALHFVQHHFSLLFKSSDFLEMNFGVLQKCLESDELNVPEEEMVLKVVLSWTKHNLESRQKYLPHLIEKVRLHQLSEETLQDCLFNEESLLKSTNCFDIIMDAIKCVQGSGGLFPDARPSTTEKYIFIHKTEENGENQYTFCYNIKSDSWKILPQSHLIDLPGSSLSSYGEKIFLTGGCKGKCCRTVRLHIAESYHDATDQTWCYCPVKNDFFLVSTMKTPRTMHTSVMALDRLFVIGGKTRGSRDIKSLLDVESYNPLSKEWISVSPLPRGIYYPEASTCQNVIYVLGSEVEITDAFNPSLDCFFKYNATTDQWSELVAEFGQFFHATLIKAVPVNCTLYICDLSTYKVYSFCPDTCVWKGEGSFECAGFNAGAIGIEDKIYILGGDYAPDEITDEVQVYHSNRSEWEEVSPMPRALTEFYCQVIQFNKYRDPWFSNLCA

SEQ ID NO: 32 - protein, 572 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 33 - protein, 152 aa, Homo sapiens
MEELDRQKIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 34 - protein, 378 aa, Homo sapiens
MASSSPDSPCSCDCFVSVPPASAIPAVIFAKNSDRPRDEVQEVVFVPAGTHTPGSRLQCTYIEVEQVSKTHAVILSRPSWLWGAEMGANEHGVCIGNEAVWTKEPVGEGEALLGMDLLRLALERSSSAQEALHVITGLLEHYGQGGNCLEDAAPFSYHSTFLLADRTEAWVLETAGRLWAAQRIQEGARNISNQLSIGTDISAQHPELRTHAQAKGWWDGQGAFDFAQIFSLTQQPVRMEAAKARFQAGRELLRQRQGGITAEVMMGILRDKESGICMDSGGFRTTASMVSVLPQDPTQPCVHFLTATPDPSRSVFKPFIFGMGVAQAPQVLSPTFGAQDPVRTLPRFQTQVDRRHTLYRGHQAALGLMERDQVSPRE

SEQ ID NO: 35 - protein, 604 aa, Homo sapiens
MAGDVEGFCSSIHDTSVSAGFRALYEEGLLLDVTLVIEDHQFQAHKALLATQSDYFRIMFTADMRERDQDKIHLKGLTATGFSHVLQFMYYGTIELSMNTVHEILQAAMYVQLIEVVKFCCSFLLAKICLENCAEIMRLLDDFGVNIEGVREKLDTFLLDNFVPLMSRPDFLSYLSFEKLMSYLDNDHLSRFPEIELYEAVQSWLRHDRRRWRHTDTIIQNIRFCLMTPTSVFEKVKTSEFYRYSRQLRYEVDQALNYFQNVHQQPLLDMKSSRIRSAKPQTTVFRGMIGHSMVNSKILLLKKPRVWWELEGPQVPLRPDCLAIVNNFVFLLGGEELGPDGEFHASSKVFRYDPRQNSWLQMADMSVPRSEFAVGVIGKFIYAVAGRTRDETFYSTERYDITNDKWEFVDPYPVNKYGHEGTVLNNKLFITGGITSSSTSKQVCVFDPSKEGTIEQRTRRTQVVTNCWENKSKMNYARCFHKMISYNGKLYVFGGVCVILRASFESQGCPSTEVYNPETDQWTILASMPIGRSGHGVTVLDKQIMVLGGLCYNGHYSDSILTFDPDENKWKEDEYPRMPCKLDGLQVCNLHFPDYVLDEVRRCN

SEQ ID NO: 36 - protein, 304 aa, Homo sapiens
MSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 37 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 38 - protein, 140 aa, Homo sapiens
MAGWNAYIDNLMADGTCQDAAIVGYKDSPSVWAAVPGKTFVNITPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 39 - protein, 390 aa, Homo sapiens
MPSKSLSNLSVTTGANESGSVPEGWERDFLPASDGTTTELVIRCVIPSLYLLIITVGLLGNIMLVKIFITNSAMRSVPNIFISNLAAGDLLLLLTCVPVDASRYFFDEWMFGKVGCKLIPVIQLTSVGVSVFTLTALSADRYRAIVNPMDMQTSGALLRTCVKAMGIWVVSVLLAVPEAVFSEVARISSLDNSSFTACIPYPQTDELHPKIHSVLIFLVYFLIPLAIISIYYYHIAKTLIKSAHNLPGEYNEHTKKQMETRKRLAKIVLVFVGCFIFCWFPNHILYMYRSFNYNEIDPSLGHMIVTLVARVLSFGNSCVNPFALYLLSESFRRHFNSQLCCGRKSYQERGTSYLLSSSAVRMTSLKSNAKNMVTNSVLLNGHSMKQEMAL

SEQ ID NO: 40 - protein, 501 aa, Homo sapiens
MQVCSQPQRGCVREQSAINTAPPSAHNAASPGGARGHRVPLTEACKDSRIGGMMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 41 - protein, 285 aa, Homo sapiens
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 42 - protein, 569 aa, Homo sapiens
MDPAEAVLQEKALKFMNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 43 - protein, 317 aa, Homo sapiens [sequence omitted]

SEQ ID NO: 44 - protein, 147 aa, Homo sapiens
MASHRLLLLCLAGLVFVSEAGPTGTGESKCPLMVKVLDAVRGSPAINVAVHVFRKAADDTWEPFASGKTSESGELHGLTTEEEFVEGIYKVEIDTKSYWKALGISPFHEHAEVVFTANDSGPRRYTIAALLSPYSYSTTAVVTNPKE

SEQ ID NO: 45 - protein, 1012 aa, Homo sapiens
MMAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELNQKLQEEKHKSITEALRRQEQNIKSFEETYDRKLKNELLKYQLELKDDYIIRTNRLIEDERKNKEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 46 - protein, 393 aa, Homo sapiens
MLRRLLERPCTLALLVGSQLAVMMYLSLGGFRSLSALFGRDQGPTFDYSHPRDVYSNLSHLPGAPGGPPAPQGLPYCPERSPLLVGPVSVSFSPVPSLAEIVERNPRVEPGGRYRPAGCEPRSRTAIIVPHRAREHHLRLLLYHLHPFLQRQQLAYGIYVIHQAGNGTFNRAKLLNVGVREALRDEEWDCLFLHDVDLLPENDHNLYVCDPRGPRHVAVAMNKFGYSLPYPQYFGGVSALTPDQYLKMNGFPNEYWGWGGEDDDIATRVRLAGMKISRPPTSVGHYKMVKHRGDKGNEENPHRFDLLVRTQNSWTQDGMNSLTYQLLARELGPLYTNITADIGTDPRGPRAPSGPRYPPGSSQAFRQEMLQRRPPARPGPLSTANHTALRGSH

SEQ ID NO: 47 - protein, 403 aa, Homo sapiens
MATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLNEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQSDNDLLTQTRTIAMSLVKCASSDTQDQYKLVKDISF

SEQ ID NO: 48 - protein, 464 aa, Homo sapiens
MRAARRGLHCAGAERPRRRGRLWDSSGVPQRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 49 - protein, 1455 aa, Homo sapiens
CSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 50 - protein, 203 aa, Homo sapiens [sequence omitted]

SEQ ID NO: 51 - protein, 241 aa, Homo sapiens
MFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 52 - protein, 517 aa, Homo sapiens [sequence omitted]

SEQ ID NO: 53 - protein, 284 aa, Homo sapiens
MASYPYRQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 54 - protein, 157 aa, Homo sapiens
MATSVLCCLRCCRDGGTGHIPLKEMPAVQLDTQHMGIWGIGVATQKVNLNQIPLGRDMHSLVMRNDGALYHNNEEKNRLPANSLPQEGDVVGITYDHVELNVYLNGKNMHCPASGIRGTVYPVVYVDDSAILDCQFSEFYHTPPPGFEKILFEQQIF

SEQ ID NO: 55 - protein, 413 aa, Homo sapiens
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 56 - protein, 433 aa, Homo sapiens
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 57 - protein, 673 aa, Homo sapiens
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 58 - protein, 471 aa, Homo sapiens
MAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 59 - protein, 558 aa, Homo sapiens
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 60 - protein, 1317 aa, Homo sapiens
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRLEEQEKEQVMLVAHLEEQLREKQEMIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYERMVSRSLGANPDDLKDPIKISIPRYVLCGQGKDAHFEFEVKITVLDETWTVFRRYSRFREMHKTLKLKYAELAALEFPPKKLFGNKDERVIAERRSHLEKYLRDFFSVMLQSATSPLHINKVGLTLSKHTICEFSPFFKKGVFDYSSHGTG

SEQ ID NO: 61 - protein, 259 aa, Homo sapiens
MSKYKLIMLRHGEGAWNKENRFCSWVDQKLNSEGMEEARNCGKQLKALNFEFDLVFTSVLNRSIHTAWLILEELGQEWVPVESSWRLNERHYGALIGLNREQMALNHGEEQVRLWRRSYNVTPPPIEESHPYYQEIYNDRRYKVCDVPLDQLPRSESLKDVLERLLPYWNERIAPEVLRGKTILISAHGNSSRALLKHLEGISDEDIINITLPTGVPILLELDENLRAVGPHQFLGDQEAIQAAIKKVEDQGKVKQAKK

SEQ ID NO: 62 - protein, 314 aa, Homo sapiens
MAFVTRQFMRSVSSSSTASASAKKIIVKHVTVIGGGLMGAGIAQVAAATGHTVVLVDQTEDILAKSKKGIEESLRKVAKKKFAENLKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGDASKEDIDTAMKLGAGYPMGPFELLDYVGLDTTKFIVDGWHEMDAENPLHQPSPSLNKLVAENKFGKKTGEGFYKYK

SEQ ID NO: 63 - protein, 295 aa, Homo sapiens
MSTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQAYPTYPNSPVQVITGYQLPVYNYQMPPQWPVGEQRSYVVPPAYSAVNYHCNEVDPGAEVVPNECSVHEATPPSGNGPQKKSVDRSIQTVVSCLFNPENRLRNSVVTQDDYFKDKRVHHFRRSRAMLKSV

SEQ ID NO: 64 - protein, 273 aa, Homo sapiens
MSGDKLLSELGYKLGRTIGEGSYSKVKVATSKKYKGTVAIKVVDRRRAPPDFVNKFLPRELSILRGVRHPHIVHVFEFIEVCNGKLYIVMEAAATDLLQAVQRNGRIPGVQARDLFAQIAGAVRYLHDHHLVHRDLKCENVLLSPDERRVKLTDFGFGRQAHGYPDLSTTYCGSAAYASPEVLLGIPYDPKKYDVWSMGVVLYVMVTGCMPFDDSDIAGLPRRQKRGVLYPEGLELSERCKALIAELLQFSPSARPSAGQVARNCWLRAGDSG

SEQ ID NO: 65 - protein, 1729 aa, Homo sapiens
MKVSTLRESSAMASPLPREMEEELVPTGSEPGDTRAKPPVKPKPRALPAKPALPAKPSLLVPVGPRPPRGPLAELPSARKMNMLAGPQPYGGSKRPLPFAPRPAVEASTGGEATQETGKEEAGKEEPPPLTPPARCAAPGGVRKAPAPFRPASERFAATTVEEILAKMEQPRKEVLASPDRLWGSRLTFNHDGSSRYGPRTYGTTTAPRDEDGSTLFRGWSQEGPVKSPAECREEHSKTPEERSLPSDLAFNGDLAKAASSELPADISKPWIPSSPAPSSENGGPASPGLPAEASGSGPGSPHLHPPDKSSPCHSQLLEAQTPEASQASPCPAVTPSAPSAALPDEGSRHTPSPGLPAEGAPEAPRPSSPPPEVLEPHSLDQPPATSPRPLIEVGELLDLTRTFPSGGEEEAKGDAHLRPTSLVQRRFSEGVLQSPSQDQEKLGGSLAALPQGQGSQLALDRPFGAESNWSLSQSFEWTFPTRPSGLGVWRLDSPPPSPITEASEAAEAAEAGNLAVSSREEGVSQQGQGAGSAPSGSGSSWVQGDDPSMSLTQKGDGESQPQFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQMDWTQDLAPQNVELFGAPSEAREHGVGGVSQCPEPGLRHNGSLSPGLEARDPLEARELGVGETSGPETQGEDYSSSSLEPHPADPGMETGEALSFGASPGRCPARPPPSGSQGLLEEMLAASSSKAVARRESAASGLGGLLEEEGAGAGAAQEEVLEPGRDSPPSWRPQPDGEASQTEDVDGTWGSSAARWSDQGPAQTSRRPSQGPPARSPSQDFSFIEDTEILDSAMYRSRANLGRKRGHRAPVIRPGGTLGLSEAADSDAHLFQDSTEPRASRVPSSDEEVVEEPQSRRTRMSLGTKGLKVNLFPGLSPSALKAKLRPRNRSAEEGELAESKSSQKESAVQRSKSCKVPGLGKPLTLPPKPEKSSGSEGSSPNWLQALKLKKKKV

SEQ ID NO: 66 - protein, 497 aa, Homo sapiens
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 67 - protein, 447 aa, Homo sapiens [sequence omitted]

SEQ ID NO: 68 - protein, 594 aa, Homo sapiens
MNADFLLPYYTAQSGSSMSMFDTTMGKLQRQLYKGEYDIFKYAPIFESDFIQITKRGEVIDVHNRVRMVTMGIARTSPILPLPDVMLLARPATGCEEYAGHGQATKRKKRKAAKNLELTRLLPLRFVRISVQDHEKQQLRLKFATGRSCYLQLCPALDTRDDLFAYWEKLIYLLRPPMESNSSTCGIPAEDMMWMPVFQEDRRSLGAVNLQGKGDQDQVSIQSLHMVSEVCGATSAAYAGGEGLQNDFNKPTNVLNASIPKTSTELAEEPATGGIKEAAAAGAAAGAATGTVAGALSVAAANSAPGQVSAAIAGAATIDAGGNKGNMALAGTASMAPNSTKVAVAGAAGKSSEHVSSASMSLSREGSVSLAIAGVVLTSRTAAEADMDAAAGPPVSTRQSKSSLSGQHGRERTQASAEGCKEGRERREKDRALGRSSHRRRTGESRHKTRGDKIAQKSSSRSSFSHRANRDDKKEKGCGNPGSSRHRDSHKGVSHTPISKESRTSHKSGRSLWTTSSGSSKGLGRVSSFLRNVRANLTTKVVGTPHGRDVDVMAKMAERSTNVAIAETAEGGQGLEMVGSMTPDIMETVTFEAH

SEQ ID NO: 69 - protein, 360 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 70 - protein, 309 aa, Homo sapiens
MEELLRRELGCSSVRATGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVGRGGGQEERPFVARFGFDVVTCCGYLPQVNDWQEDWVVFYARQRIQPQMDMVEKESGDREALQLWSALQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSSLNIMRNLVK

SEQ ID NO: 71 - protein, 90 aa, Homo sapiens
MDNMSPRLRAFLSEPIGEKDVCWVDGISHELAINLVTKGINKAYILLGQFLLMHKNEAEFQRWLICCFGATECEAQQTSHCLKEWCACFL

SEQ ID NO: 72 - protein, 454 aa, Homo sapiens [sequence omitted]

SEQ ID NO: 73 - protein, 182 aa, Homo sapiens
MSTSSSSSWDNLLESLSLSTVWNWIQASFLGETSAPQQTSLGLLDNLAPAVQIILRISFLILLGIGIYALWKRSIQSIQKTLLFVITLYKLYKKGSHIFEALLANPEGSGLRIQDNNNLFLSLGLQEKILKKLKTVENKMKNLEGIIVAQKPATKRDCSSEPYCSCSDCQSPLSTSGFTSPI

SEQ ID NO: 74 - protein, 677 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 75 - protein, 505 aa, Homo sapiens
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRLKDANDVPIQCEISPLISYAGEGLESYVADKEFHAPLIIDENGVHELVKNGI

SEQ ID NO: 76 - protein, 942 aa, Homo sapiens
MAAAAEPGARAWLGGGSPRPGSPACSPVLGSGGRARPGPGPGPGPERAGVRAPGPAAAPGHSFRKVTLTKPTFCHLCSDFIWGLAGFLCDVCNFMSHEKCLKHVRIPCTSVAPSLVRVPVAHCFGPRGLHKRKFCAVCRKVLEAPALHCEVCELHLHPDCVPFACSDCRQCHQDGHQDHDTHHHHWREGNLPSGARCEVCRKTCGSSDVLAGVRCEWCGVQAHSLCSAALAPECGFGRLRSLVLPPACVRLLPGGFSKTQSFRIVEAAEPGEGGDGADGSAAVGPGRETQATPESGKQTLKIFDGDDAVRRSQFRLVTVSRLAGAEEVLEAALRAHHIPEDPGHLELCRLPPSSQACDAWAGGKAGSAVISEEGRSPGSGEATPEAWVIRALPRAQEVLKIYPGWLKVGVAYVSVRVTPKSTARSVVLEVLPLLGRQAESPESFQLVEVAMGCRHVQRTMLMDEQPLLDRLQDIRQMSVRQVSQTRFYVAESRDVAPHVSLFVGGLPPGLSPEEYSSLLHEAGATKATVVSVSHIYSSQGAVVLDVACFAEAERLYMLLKDMAVRGRLLTALVLPDLLHAKLPPDSCPLLVFVNPKSGGLKGRDLLCSFRKLLNPHQVFDLTNGGPLPGLHLFSQVPCFRVLVCGGDGTVGWVLGALEETRYRLACPEPSVAILPLGTGNDLGRVLRWGAGYSGEDPFSVLLSVDEADAVLMDRWTILLDAHEAGSAENDTADAEPPKIVQMSNYCGIGIDAELSLDFHQAREEEPGKFTSRLHNKGVYVRVGLQKISHSRSLHKQIRLQVERQEVELPSIEGLIFINIPSWGSGADLWGSDSDTRFEKPRMDDGLLEVVGVTGVVHMGQVQGGLRSGIRIAQGSYFRVTLLKATPVQVDGEPWVQAPGHMIISAAGPKVHMLRKAKQKPRRAGTTRDARADAAPAPESDPR

SEQ ID NO: 77 - protein, 626 aa, Homo sapiens
MMANDAKPDVKTVQVLRDTANRLRIHSIRATCASGSGQLTSCCSAAEVVSVLFFHTMKYKQTDPEHPDNDRFILSRGHAAPILYAAWVEVGDISESDLLNLRKLHSDLERHPTPRLPFVDVATGSLGQGLGTACGMAYTGKYLDKASYRVFCLMGDGESSEGSVWEAFAFASHYNLDNLVAVFDVNRLGQSGPAPLEHGADIYQNCCEAFGWNTYLVDGHDVEALCQAFWQASQVKNKPTAIVAKTFKGRGIPNIEDAENWHGKPVPKERADAIVKLIESQIQTNENLIPKSPVEDSPQISITDIKMTSPPAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 78 - protein, 395 aa, Homo sapiens
MVSAAGLSGDGKMRGVLLVLLGLLYSSTSCGVQKASVFYGPDPKEGLVSSMEFPWVVSLQDSQYTHLAFGCILSEFWVLSIASAIQNRKDIVVIVGISNMDPSKIAHTEYPVNTIIIHEDFDNNSMSNNIALLKTDTAMHFGNLVQSICFLGRMLHTPPVLQNCWVSGWNPTSATGNHMTMSVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 79 - protein, 498 aa, Homo sapiens [sequence omitted]

SEQ ID NO: 80 - protein, 406 aa, Homo sapiens
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 81 - protein, 415 aa, Homo sapiens
MATRNSPMPLGTAQGDPGEAGTRPGPDASLRDTGAATQLKMKPRKVHKIKAVIIDLGSQYCKCGYAGEPRPTYFISSTVGKRCPEAADAGDTRKWTLVGHELLNTEAPLKLVNPLKHGIVVDWDCVQDIWEYIFRTAMKILPEEHAVLVSDPPLSPSSNREKYAELMFETFGIPAMHVTSQSLLSIYSYGKTSGLVVESGHGVSHVVPISEGDVLPGLTSRADYAGGDLTNYLMQLLNEAGHAFTDDHLHIIEHIKKKCCYAAFLPEEELGLVPEELRVDYELPDGKLITIGQERFRCSEMLFQPSLAGSTQPGLPELTAACLGRCQDTGFKEEMAANVLLCGGCTMLDGFPERFQRELSLLCPGDSPAVAAAPERKTSVWTGGSILASLQAFQQLWVSKEEFEERGSVAIYSKC

SEQ ID NO: 82 - protein, 342 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHSLLTTVGWDHQVVHHVVPTEPLPAPGPASVTE

SEQ ID NO: 83 - protein, 321 aa, Homo sapiens
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 84 - protein, 648 aa, Homo sapiens
MGCAEGKAVAAAAPTELQTKGKNGDGRRRSAKDHHPGKTLPENPAGFTSTATADSRALLQAYIDGHSVVIFSRSTCTRCTEVKKLFKSLCVPYFVLELDQTEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCG

SEQ ID NO: 85 - protein, 1822 aa, Homo sapiens
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQERLRHMIPRQTDFNLMRITYRFQEKYKHVKEDLAHLHFEKLERFQKLKEEQRCFDIEKQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRLEEDAFAREQREKRRRKLLMDQLIAHEAQEEAYREEQLINRLMRQSQQERRIAVQLMHVRHEKEVLWQNRIFREKQHEERRLKDFQDALDREAALAKQAKIDFEEQFLKEKRFHDQIAVERAQARYEKHYSVCAEILDQIVDLSTKVADYRMLTNNLIPYKLMHDWKELFFNAKPIYEQASVKTLPANPSREQLTELEKRDLLDTNDYEEYKNMVGEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGETMLSANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEIAKKKNKVEKKLEEKEAEKKAAASLAELPLPTPPPAPPPEPEKEKEIHQSHVASKTPTAKGKPQSEAPHGKQESLQEGKGKKGETALKRKGSPKGKSSGGKVPVKKSPADSTDTSPVAIVPQPPKPGSEEWVYVNEPVPEEMPLFLVPYWELIENSYINTIKTVLRHLREDQHTVLAYLYEIRTSFQEFLKRPDHKQDFVAQWQADFNSLPDDLWDDEETKAELHQRVNDLRDRLWDICDARKEEAEQERLDIINESWLQDTLGMTMNHFFSLMQAELNRFQDTKRLLQDYYWGMESKIPVEDNKRFTRIPLVQLDSKDNSESQLRIPLVPRISISLETVTPKPKTKSVLKGKMDNSLENVESNFEADEKLVMDTWQQASLAVSHMVAAEIHQRLMEEEKENQPADPKEKSPQMGANKKVKKEPPKKKQEDKKPKGKSPPMAEATPVIVTTEEIAEIKRKNELRVKIKEEHLAALQFEEIATQFRLELIKTKALALLEDLVTKVVDVYKLMEKWLGERYLNEMASTEKLTDVARYHIETSTKIQNELYLSQEDFFINGNIKVFPDPPPSIRPPPVEKEEDGTLTIEQLDSLRDQFLDMAPKGIIGNKAFTDILIDLVTLNLGTNNFPSNWMHLTQPELQELTSLLTVNSEFVDWRKFLLVTSMPWPIPLEEELLETLQKFKAVDKEQLGTITFEQYMQAGLWFTGDEDIKIPENPLEPLPFNRQEHLIEFFFRLFADYEKDPPQLDYTQMLLYFACHPDTVEGVYRALSVAVGTHVFQQVKASIPSAEKTSSTDAGPAEEFPEPEENAAREERKLKDDTEKREQKDEEIPENANNEKMSMETLLKVFKGGSEAQDSNRFASHLKIENIYAEGFIKTFQDLGAKNLEPIEVAVLLKHPFIQDLISNYSDYKFPDIKIILQRSEHVQGSDGERSPSRHTEEKK

SEQ ID NO: 86 - protein, 201 aa, Homo sapiens
MALSWVLTVLSLLPLLEAQIPLCANLVPVPITNATLDRITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 87 - protein, 95 aa, Homo sapiens
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 88 - protein, 212 aa, Homo sapiens
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEEIEWLKFLALACSALGVTITKTLKIVCEVLSCDHNGGSPRIPFSTFQFLYTYIAKVDGEISASHVSRMLNYMEQEVIGPDGIITVNDFTQNPRVQLE

SEQ ID NO: 89 - protein, 273 aa, Homo sapiens
MILKGCLLYPLCSPRNKQRCARLWKIAYGGLLKIVTGSLLTFYVVLCLDGGMVLMRKQVPSRFMYPKEWQHLTMFILLTLNGCVDFMSKNVLPQRCVGLEKGTLVLIIYELLLLMVSHVKDSEGVELHVYSLLILVVFLLLLVLTAELWAPNMCHLQLMETFLILMMGSWLMQAGFILYRPVSGYPWQDDDISDIMFVTTFFCWHVMINASFLLGIYGFSSFWYHCFRPSLKLTGPKEAPYYASTPGPLYKLLQEVEQSEKEDQALLLPKSSP

SEQ ID NO: 90 - protein, 400 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 91 - protein, 204 aa, Homo sapiens
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKIDKTDYMVGSYGPRAEEYEFLTPVEEAPKGMLARGSYSIKSRFTDDDKTDHLSWEWNLTIKKDWKD

SEQ ID NO: 92 - protein, 94 aa, Homo sapiens
MAAFPHKIIFFLVCSTLTHVAFSGIFNKRDFTRWPKPRCKMYIPLDPDYNADCPNVTAPVCASNGHTFQNECFFCVEQREFHYRIKFEKYGKCD

SEQ ID NO: 93 - protein, 223 aa, Homo sapiens
MTRWSSYLLGWTTFLLYSYESSGGMHEECVFPFTYKGSVYFTCTHIHSLSPWCATRAVYNGQWKYCQSEDYPRCIFPFIYRGKAYNSCISQGSFLGSLWCSVTSVFDEKQQWKFCETNEYGGNSLRKPCIFPSIYRNNVVSDCMEDESNKLWCPTTENMDKDGKWSFCADTRISALVPGFPCHFPFNYKNKNYFNCTNKGSKENLVWCATSYNYDQDHTWVYC

SEQ ID NO: 94 - protein, 363 aa, Homo sapiens
MEPKPQKSPGKQFTFSYENEVCKQDYFIKSPPSQLFSSVTSWKKRFFILSKAGEKSFSLSYYKDHHHRGSIEIDQNSSVEVGISSQEKMQSVQKMFKCHPDEVMSIRTTNREYFLIGHDREKIKDWVSFMSSFRQDIKATQQNTEEELSLGNKRTLFYSSPLLGPSSTSEAVGSSSPRNGLQDKHLMEQSSPGFRQTHLQDLSEATQDVKEENHYLTPRSVLLELDNIIASSDSGESIETDGPDQVSGRIECHYEPMESYFFKETSHESVDSSKEEPQTLPETQDGDLHLQEQGSGIDWCLSPADVEAQTTNDQKGSASLTVVQLSILINNIPDESQVEKLNVFLSPPDVINYLALTEATGRI

SEQ ID NO: 95 - protein, 504 aa, Homo sapiens
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 96 - protein, 286 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPSTTQVVGILKIQVHYYEDGNVQLVSHKDIQDSLTVSNEVQTAKEFIKIVEAAENEYQTAISENYQTMSDTTFKALRRQLPVTRTKIDWNKILSYKIGKEMQNA

SEQ ID NO: 97 - protein, 501 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 98 - protein, 272 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEGDSKAAELIANSLATAGDGLIELRKLEAAEDIAYQLSRSRNITYLPAGQSVLLQLPQ

SEQ ID NO: 99 - protein, 163 aa, Homo sapiens
MMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPNGGKPKAM

SEQ ID NO: 100 - protein, 646 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 101 - protein, 360 aa, Homo sapiens
MATKLRQILFGNTVHVFSYNWKKAYFRFHDPSSELAFTLEVGKGGARSIQMAVQGSIIKYLLFTRKGKDCNLGNLCEISKKEQEQALAAALAGILWAAGAAQKATICLVTEDIYVASTPDYSVDNFTERLQLFEFLEKEAAEKFIYDHLLCFRGEGSHGVILFLYSLIFSRTFERLQMDLDVTTTQLLQPNAGGFLCRQAVLNMILTGRASPNVFNGCEEGKSQETLHGVLTRSDVGYLQWGKDASEDDRLSQVGSMLKTPKLPIWLCNINGNYSILFCTNRQLLSDWKMERLFDLYFYSGQPSQKKLVRLTIDTHSHHWERDQQEEKHGPRRRFSPVEMAIRTKWSEATINWNGTVPFF

SEQ ID NO: 102 - protein, 374 aa, Homo sapiens
MANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 103 - protein, 406 aa, Homo sapiens
MPPVGGKKAKKGILERLNAGEIVIGDGGFVFALEKRGYVKAGPWTPEAAVEHPEAVRQLHREFLRAGSNVMQTFTFYASEDKLENRGNYVLEKISGQEVNEAACDIARQVADEGDALVAGGVSQTPSYLSCKSETEVKKVFLQQLEVFMKKNVDFLIAEYFEHVEEAVWAVETLIASGKPVAATMCIGPEGDLHGVPPGECAVRLVKAGASIIGVNCHFDPTISLKTVKLMKEGLEAARLKAHLMSQPLAYHTPDCNKQGFIDLPEFPFGLEPRVATRWDIQKYAREAYNLGVRYIGGCCGFEPYHIRAIAEELAPERGFLPPASEKHGSWGSGLDMHTKPWVRARARKEYWENLRIASGRPYNPSMSKPDGWGVTKGTAELMQQKEATTEQQLKELFEKQKFKSQ

SEQ ID NO: 104 - protein, 1663 aa, Homo sapiens
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 105 - protein, 342 aa, Homo sapiens
MASVTRAVFGELPSGGGTVEKFQLQSDLLRVDIISWGCTITALEVKDRQGRASDVVLGFAELEGYLQKQPYFGAVIGRVANRIAKGTFKVDGKEYHLAINKEPNSLHGGVRGFDKVLWTPRVLSNGVQFSRISPDGEEGYPGELKVWVTYTLDGGELIVNYRAQASQATPVNLTNHSYFNLAGQASPNINDHEVTIEADTYLPVDETLIPTGEVAPVQGTAFDLRKPVELGKHLQDFHLNGFDHNFCLKGSKEKHFCARVHHAASGRVLEVYTTQPGVQFYTGNFLDGTLKGKNGAVYPKHSGFCLETQNWPDAVNQPRFPPVLLRPGEEYDHTTWFKFSVA

SEQ ID NO: 106 - protein, 474 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 107 - protein, 854 aa, Homo sapiens
MPPCSGGDGSTPPGPSLRDRDCPAQSAEYPRDRLDPRPGSPSEASSPPFLRSRAPVNWYQEKAQVFLWHLMVSGSTTLLCLWKQPFHVSAFPVTASLAFRQSQGAGQHLYKDLQPFILLRLLMPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 108 - protein, 289 aa, Homo sapiens
MSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 109 - protein, 189 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 110 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 111 - protein, 165 aa, Homo sapiens
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 112 - protein, 592 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 113 - protein, 698 aa, Homo sapiens
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAVAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 114 - protein, 646 aa, Homo sapiens; identical to SEQ ID NO: 100

SEQ ID NO: 115 - protein, 123 aa, Homo sapiens
MKLLLLALPMLVLLPQVIPAYSGEKKCWNRSGHCRKQCKDGEAVKDTCKNLRACCIPSNEDHRRVPATSPTPLSDSTPGIIDDILTVRFTTDYFEVSSKKDMVEESEAGRGTETSLPNVHHSS

SEQ ID NO: 116 - protein, 205 aa, Homo sapiens
MMRTLITTHPLPLLLLPQQLLQLVQFQEVDTDFDFPEEDKKEEFEECLEKFFSTGPARPPTKEKVKRRVLIEPGMPLNHIEYCNHEIMGKNVYYKHRWVAEHYFLLMQYDELQKICYNRFVPCKNGIRKCNRSKGLVEGVYCNLTEAFEIPACKYESLYRKGYVLITCSWQNEMQKRIPHTINDLVEPPEHRSFLSEDGVFVISP

SEQ ID NO: 117 - protein, 221 aa, Homo sapiens
MTTQLRVVHLLPLLLACFVQTSPKQEKMKMDCHKDEKGTIYDYEAIALNKNEYVSFKQYVGKHILFVNVATYCGLTAQYPELNALQEELKPYGLVVLGFPCNQFGKQEPGDNKEILPGLKYVRPGGGFVPSFQLFEKGDVNGEKEQKVFSFLKHSCPHPSEILGTFKSISWDPVKVHDIRWNFEKFLVGPDGIPVMRWSHRATVSSVKTDILAYLKQFKTK

SEQ ID NO: 118 - protein, 677 aa, Homo sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 119 - protein, 422 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 120 - protein, 491 aa, Homo sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 121 - protein, 536 aa, Homo sapiens
MELSPRSPPEMLEESDCPSPLELKSAPSKKMWIKLRSLLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 122 - protein, 327 aa, Homo sapiens
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 123 - protein, 358 aa, Homo sapiens
MQAAALPEEIRWLLEDAEEFLAEGLRNENLSAVARDHRDHILRGFQQIKARYYWDFQPQGGDIGQDSSDDNHSGTLGLSLTSDAPFLSDYQDEGMEDIVKGAQELDNVIKQGYLEKKSKDHSFFGSEWQKRWCVVSRGLFYYYANEKSKQPKGTFLIKGYGVRMAPHLRRDSKKESCFELTSQDRRSYEFTATSPAEARDWVDQISFLLKDLSSLTIPYEEDEEEEEKEETYDDIDGFDSPSCGSQCRPTILPGSVGIKEPTEEKEEEDIYEVLPDEEHDLEEDESGTRRKGDYASYYQGLWDCHGDQPDELSFQRGDLIRILSKEYNMYGWWVGELNSLVGIVPKEYLTTAFEVEER

SEQ ID NO: 124 - protein, 248 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDKLKCTKEEHLCTQRMLDQTLLDLNEM

SEQ ID NO: 125 - protein, 464 aa, Homo sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 126 - protein, 199 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 127 - protein, 147 aa, Homo sapiens
MIIMVIIFLVLLFWENEVNDEAVMSTLEHLHVDYPQNDVPVPARYCNHMIIQRVIREPDHTCKKEHVFIHERPRKINGICISPKKVACQNLSAIFCFQSETKFKMTVCQLIEGTRYPACRYHYSPTEGFVLVTCDDLRPDSFLGYVK

SEQ ID NO: 128 - protein, 156 aa, Homo sapiens
MAPAVTRLLFLQLVLGPTLVMDIKMQIGSRNFYTLSIDYPRVNYPKGFRGYCNGLMSYMRGKMQNSDCPKIHYVIHAPWKAIQKFCKYSDSFCENYNEYCTLTQDSLPITVCSLSHQQPPTSCYYNSTLTNQKLYLLCSRKYEADPIGIAGLYSGI

SEQ ID NO: 129 - protein, 364 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 130 - protein, 373 aa, Homo sapiens
MTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQGPYYCGVGADRAYGRDIVEAHYRACLYAGVKIAGTNAEVMPAQWEFQIGPCEGISMGDHLWVARFILHRVCEDFGVIATFDPKPIPGNWNGAGCHTNFSTKAMREENGLKYIEEAIEKLSKRHQYHIRAYDPKGGLDNARRLTGFHETSNINDFSAGVANRSASIRIPRTVGQEKKGYFEDRRPSANCDPFSVTEALIRTCLLNETGDEPFQYKN

SEQ ID NO: 131 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 132 - protein, 297 aa, Homo sapiens
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFALKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 133 - protein, 350 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFASQQQKPEDTTIPSTELAKQVIEYARQLEMIV

SEQ ID NO: 134 - protein, 223 aa, Homo sapiens
MNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 135 - protein, 505 aa, Homo sapiens
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 136 - protein, 292 aa, Homo sapiens
MGEKSENCGVPEDLLNGLKVTDTQEAECAGPPVPDPKNQHSQSKLLRDDEAHLQEDQGEEECFHDCSASFEEEPGADKVENKSNEDVNSSELDEEYLIELEKNMSDEEKQKRREESTRLKEEGNEQFKKGDYIEAESSYSRALEMCPSCFQKERSILFSNRAAARMKQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSYSINFVQNPNNNR

SEQ ID NO: 137 - protein, 357 aa, Homo sapiens
MAAAAKPNNLSLVVHGPGDLRLENYPIPEPGPNEVLLRMHSVGICGSDVHYWEYGRIGNFIVKKPMVLGHEASGTVEKVGSSVKHLKPGDRVAIEPGAPRENDEFCKMGRYNLSPSIFFCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGQLGCKPEVTIECTGAEASIQAGIYATRSGGNLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 138 - protein, 511 aa, Homo sapiens
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIWRLEVWDQGISRIGFF

SEQ ID NO: 139 - protein, 271 aa, Homo sapiens
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 140 - protein, 271 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 141 - protein, 417 aa, Homo sapiens
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 142 - protein, 535 aa, Homo sapiens
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 143 - protein, 272 aa, Homo sapiens
AIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESNVPGDKDCVMSRQKHHAISAKLNKPFLFDTKPLIVQYEVNFQNGIECGGAYVNCFLKHQNFNRDQFHDKTPYTIMFGPDKCGEDYKLQFIFRHKNPKTGIYEEKHAKRPDADLKTYFMILYTLILNPDNSFEILVDQSTPPVNPSREIEDPEDRKPEDWDERPKIPDPEAVKPDD

SEQ ID NO: 144 - protein, 118 aa, Homo sapiens
MDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVQ

SEQ ID NO: 145 - protein, 345 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKVPVKKATVVYQGERVKIQEKFKNGMLHGDKVSFFCKNKEKKCSYTEDAQCIDGTIEVPKCFKEHSSLAFWKTDASDVKPC

SEQ ID NO: 146 - protein, 935 aa, Homo sapiens [sequence omitted]

SEQ ID NO: 147 - protein, 218 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKITFVDFIAYDVLERNQVFEPSCLDAFPNLKDFISRFEGLEKISAYMKSSRFLPRPVFTKMAVWGNK

SEQ ID NO: 148 - protein, 335 aa, Homo sapiens
MEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLDTSCRWLSKSTTRSSSSC

SEQ ID NO: 149 - protein, 172 aa, Homo sapiens
MSSKRAKAKTTKKRPQRATSNVFAMFDQSQIQEFKEAFNMIDQNRDGFIDKEDLHDMLASLGKNPTDEYLEGMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 150 - protein, 807 aa, Homo sapiens
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 151 - protein, 641 aa, Homo sapiens
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTATDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 152 - protein, 364 aa, Homo sapiens
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 153 - protein, 370 aa, Homo sapiens
MSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 154 - protein, 76 aa, Homo sapiens
MKLLLLLLTVTLLLAQVTPVMKCWGKSGRCRTTCKESEVYYILCKTEAKCCVDPKYVPVKPKLTDTNTSLESTSAV

SEQ ID NO: 155 - protein, 133 aa, Homo sapiens
MLSPEAERVLRYLVEVEELAEEVLADKRQIVDLDTKRNQNREGLRALQKDLSLSEDVMVCFGNMFIKMPHPETKEMIEKDQDHLDKEIEKLRKQLKVKVNRLFEAQGKPELKGFNLNPLNQDELKALKVILKG

SEQ ID NO: 156 - protein, 307 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 157 - protein, 194 aa, Homo sapiens
MAASLVGKKIVFVTGNAKKLEEVVQILGDKFPCTLVAQKIDLPEYQGEPDEISIQKCQEAVRQVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 158 - protein, 152 aa, Homo sapiens
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 159 - protein, 289 aa, Homo sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 160 - protein, 2871 aa, Homo sapiens
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSCRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 161 - protein, 283 aa, Homo sapiens
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 162 - protein, 979 aa, Homo sapiens
MVFFSSQYRLHRKSQYLKMAAANLTFSQEVVWQRGLPSIPYSQYSFDHLYNTNDIIHTPQIRKARPQKPVSFKFLGSSSPLTGDTSLAVKTESSANPEKKLKKSKPASTVREAPRPLIHHPCMHPDMLGRPPSLDVNLEEREAWLLPPEKEARAWEATVLEKLNERTARWIQSKRPRRPGASPNKWQSFLRQQYDWSHIRDELTSASDLELLKQLEAEETAEFEDQSVILPPQEKKKPELLLPVYYRLPSYFQQAETVEIMPGNKSTEDIHEKTSLSQPQTQSYFRQVTPRAGKFAYSTDNTFEQEIYFDEVQIIHQIGAKRDQIVLENLNRYNKQLSKVFPETPEKWSAQAIPEASYRPVQGALRWTALPTPAKDMLLQVGEKDVPIKTRRLKKQAKSLQEDVTWELVVLRRMLKEWKTAWALIIEWHHETVENLLQSLGDLHDDVRIKAITTCATAALERPRIATSQRDSDKTIQDLPEVLLPALEAALCDKNAHVRMAAAICQYAIQSHNPLARNIMQTALLKGNSVDSWAAAQCLALEGTATYPVIKRILHQLFTKKNEDTEEQSYILLSYLSEKTTLIHTMLAVELNSCQWKNRIVACQAFSRISGNVCLDMKHKLIQLMWNDWNKEVRRAAAQALGQMSLGKEVHDIIRVKLGQGNSQERVEALYLIGELKLMTAKLLPSFLHCFSDDFTAVRRAACLAAGALQIRDKMVLECLLNLMQRDPYWKIKAFAIRALGQIGQVSPELTDLLLWAIHYEESPGVRLEACRSILALKLQGDRVRDTFLDVLLLENHDAVLKEMYQTMKILNLGNEGNQEMLQEIKNRIKTLSQKDLLTHKILKLEMVMGKVREEAKRVYLKPKGEQGPLTLQTLLQETFQDEMVLPRRPSEVCDTEAVIKPVKPRAPNPWLQSSVPGLTTRSKVRSSLVKDLRTSPEKRIAVGPFRSDYPALYLGKFSERTFFSPIMSSPSGKKGAHL

SEQ ID NO: 163 - protein, 421 aa, Homo sapiens
MAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCRVRHERYFLPPGVRREPVRAGRVRGTLFLPPEPGPFPGIVDMFGTGGGLLEYRASLLAGKGFAVMALAYYNYEDLPKTMETLHLEYFEEAVNYLLSHPEVKGPGVGLLGISKGGELCLSMASFLKGITAAVVINGSVANVGGTLRYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 164 - protein, 142 aa, Homo sapiens
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTVMEKKCEDA

SEQ ID NO: 165 - protein, 264 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 166 - protein, 98 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPEP

SEQ ID NO: 167 - protein, 362 aa, Homo sapiens
MELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 168 - protein, 457 aa, Homo sapiens
MATRVLSMSARLGPVPQPPAPQDEPVFAQLKPVLGAANPARDAALFPGEELKHAHHRPQAQPAPAQAPQPAQPPATGPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 169 - protein, 271 aa, Homo sapiens
MPASQSRARARDRNNVLNRAEFLSLNQPPKGGPEPRSSGRKASGPSAQPPPAGDGARERRQSQQLPEEDCMQLNPSFKGIAFNSLLAIDICMSKRLGVCAGRAASWASARSMVKLIGITGHGIPWIGGTILCLVKSSTLAGQEVLMNLLLALLLDIMTVAGVQKLIKRRGPYETSPSLLDYLTMDIYAFPAGHASRAAMVSKFFLSHLVLAVPLRVLLVLWALCVGLSRVMIGRHHVTDVLSGFVIGYLQFRLVELVWMPSSTCQMLISAW

SEQ ID NO: 170 - protein, 152 aa, Homo sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGLENDFSQESS

SEQ ID NO: 171 - protein, 199 aa, Homo sapiens
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 172 - protein, 400 aa, Homo sapiens
MSSLHKSRIADFQDVLKEPSIALEKLRELSFSGIPCEGGLRCLCWKILLNYLPLERASWTSILAKQRELYAQFLREMIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNMSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 173 - protein, 1238 aa, Homo sapiens
RAPGSLACATSWPASATRTAWLAASAPGTKWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPRMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 174 - protein, 984 aa, Homo sapiens
MRAPARGTGCCGRSGGRWLAGAAQPRCLWAGGAGQRFMVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPVGKAGKEERKGAAQEKKQLGIKDKEDKKGAKLLGKEDRPNSKKHKAKDDKKVIKSASQDRFSLEDPTPDIILSSQEPIDPLVMGKYTQSLHSEVRGLLDTLVTDLMVLADELSPIKNVEEALRLCR

SEQ ID NO: 175 - protein, 450 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 176 - protein, 314 aa, Homo sapiens
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRLLKSNSHLSEECGELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 177 - protein, 799 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 178 - protein, 475 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRSALFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 179 - protein, 329 aa, Homo sapiens
MSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 180 - protein, 239 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATCKDLVMFI

SEQ ID NO: 181 - protein, 201 aa, Homo sapiens
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 182 - protein, 516 aa, Homo sapiens
MTRGGGGGDTISKMPDVKESVPPKYPGDSEGRSCKPETSGPPQEDKSGSEDPPPFLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 183 - protein, 255 aa, Homo sapiens
MEQALTGEAQSRWPRRGGSGAMAEAPGPSGESRGHSATQLPAEKTVGGPSRGCSSSVLRVSQLVLQAISTHKGLTLAALKKELRNAGYEVRRKSGRHEAPRGQAKATLLRVSGSDAAGYFRVWKVPKPRRKPGRARQEEGTRAPWRTPAAPRSSRRRRQPLRKAARKAREVWRRNARAKAKANARARRTRRARPRAKEPPCARAKEEAGATAADEGRGQAVKEDTTPRSGKDKRRSSKPREEKQEPKKPAQRTIQ

SEQ ID NO: 184 - protein, 496 aa, Homo sapiens [sequence omitted]

SEQ ID NO: 185 - protein, 338 aa, Homo sapiens
MELWGRMLWALLSGPGRRGSTRGWAFSSWQPQPPLAGLSSAIELVSHWTGVFEKRGIPEARESSEYIVAHVLGAKTFQSLRPALWTQPLTSQQLQCIRELSSRRLQRMPVQYILGEWDFQGLSLRMVPPVFIPRPETEELVEWVLEEVAQRSHAVGSPGSPLILEVGCGSGAISLSLLSQLPQSRVIAVDKREAAISLTHENAQRLRLQDRIWIIHLDMTSERSWTHLPWGPMDLIVSNPPYVFHQDMEQLAPEIRSYEDPAALDGGEEGMDIITHILALAPRLLKDSGSIFLEVDPRHPELVSSWLQSRPDLYLNLVAVRRDFCGRPRFLHIRRSGP

SEQ ID NO: 186 - protein, 1765 aa, Homo sapiens
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGFQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGAAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFVFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENASRSSG

SEQ ID NO: 187 - protein, 538 aa, Homo sapiens
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 188 - protein, 808 aa, Homo sapiens
MLHDARDRQKFFSDVQYLRDMQHKVDSEYQACLRRQEYRRDPNEKKRDQFWGQETSFERSRFSSRSSSKQSSSEEDALTEPRSSIKISAFKCDSKLPAIDQTSVKQKHKSTMTVRKAEKVDPSEPSPADQAPMVLLRKRKPNLRRFTVSPESHSPRASGDRSRQKQQWPAKVPVPRGADQVVQQEGLMCNTKLKRPNQERRNLVPSSQPMTENAPDRAKKGDPSAPSQSELHPALSQAFQGKNSPQVLSEFSGPPLTPTTVGGPRKASFRFRDEDFYSILSLNSRRESDDTEEETQSEECLWVGVRSPCSPSHHKRSRFGGTSTPQAKNKNFEENAENCRGHSSRRSEPSHGSLRISNAMEPATERPSAGQRLSQDPGLPDRESATEKDRGGSENAKKSPLSWDTKSEPRQEVGVNAENVWSDCISVEHRPGTHDSEGYWKDYLNSSQNSLDYFISGRPISPRSSVNSSYNPPASFMHSALRDDIPVDLSMSSTSVHSSDSEGNSGFHVCQPLSPIRNRTPFASAENHNYFPVNSAHEFAVREAEDTTLTSQPQGAPLYTDLLLNPQGNLSLVDSSSSSPSRMNSEGHLHVSGSLQENTPFTFFAVSHFPNQNDNGSRMAASGFTDEKETSKIKADPEKLKKLQESLLEEDSEEEGDLCRICQIAGGSPSNPLLEPCGCVGSLQFVHQECLKKWLKVKITSGADLGAVKTCEMCKQGLLVDLGDFNMIEFYQKHQQSQAQNELMNSGLYLVLLLHLYEQRFAELMRLNHNQVERERLSRNYPQPRTEENENSELGDGNEGSISQSQVV

SEQ ID NO: 189 - protein, 219 aa, Homo sapiens
MASAGLQLLAFILALSGVSGVLTATLLPNWKVNVDVDSNIITAIVQLHGLWMDCTWYSTGMFSCALKHSILSLPIHVQAARATMVLACVLSALGICTSTVGMKCTRLGGDRETKSHASFAGGVCFMSAGISSLISTVWYTKEIIANFLDLTVPESNKHEPGGAIYIGFISAMLLFISGMIFCTSCIKRNPEARLDPPTQQPISNTQLENNSTHNLKDYV

SEQ ID NO: 190 - protein, 217 aa, Homo sapiens
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTEKRPISRAVHS

SEQ ID NO: 191 - protein, 243 aa, Homo sapiens
MRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 192 - protein, 625 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKDRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 193 - protein, 805 aa, Homo sapiens
MKDRSSTPPLHVHVDENTPVHVHIKKLPKPSATSSQKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 194 - protein, 501 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 195 - protein, 300 aa, Homo sapiens
MILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKKDRVTVVFSTVFKDDDDVVIGKVFMQEFKEGRRASHTAPQVLFSHREPPLELKDTDAAVGDNIGYITFVLFPRHTNASARDNTINLIHTFRDYLHYHIKCSKAYIHTRMRAKTSDFLKVLNRARPDAEKKEMKTITGKTFSSR

SEQ ID NO: 196 - protein, 285 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLHRGGGDLPNSQEALQKLSDVTLVPVSCSELEKAGAGLSSLCLVLSTRPHS

SEQ ID NO: 197 - protein, 367 aa, Homo sapiens
MDDAAVLKRRGYLLGINLGEGSYAKVKSAYSERLKFNVAIKIIDRKKAPADFLEKFLPREIEILAMLNHCSIIKTYEIFETSHGKVYIVMELAVQGDLLELIKTRGALHEDEARKKFHQLSLAIKYCHDLDVVHRDLKCDNLLLDKDFNIKLSDFSFSKRCLRDDSGRMALSKTFCGSPAYAAPEVLQGIPYQPKVYDIWSLGVILYIMVCGSMPYDDSNIKKMLRIQKEHRVNFPRSKHLTGECKDLIYHMLQPDVNRRLHIDEILSHCWMQPKARGSPSVAINKEGESSRGTEPLWTPEPGSDKKSATKLEPEGEAQPQAQPETKPEGTAMQMSRQSEILGFPSKPSTMETEEGPPQQPPETRAQ

SEQ ID NO: 198 - protein, 367 aa, Homo sapiens
MAPSGPGSSARRRCRRVLYWIPVVFITLLLGWSYYAYAIQLCIVSMENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLFLAYSLLYCLFIAATDLQYFIKFWTNGLPDTQAKFHIMFLFFAAAMFSVSLSSLFGYHCWLVSKNKSTLEAFRSPVFRHGTDKNGFSLGFSKNMRQVFGDEKKYWLLPIFSSLGDGCSFPTCLVNQDPEQASTPAGLNSTAKNLENHQFPAKPLRESQSHLLTDSQSWTESSINPGKCKAGMSNPALTMENET

SEQ ID NO: 199 - protein, 725 aa, Homo sapiens
MWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 200 - protein, 497 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 201 - protein, 222 aa, Homo sapiens
MAEKPKLHYSNIRGRMESIRWLLAAAGVEFEEKFIKSAEDLDKLRNDGYLMFQQVPMVEIDGMKLVQTRAILNYIASKYNLYGKDIKEKALIDMYIEGIADLGEMILLLPFSQPEEQDAKLALIQEKTKNRYFPAFEKVLKSHGQDYLVGNKLSRADIHLVELLYYVEELDSSLISSFPLLKALKTRISNLPTVKKFLQPGSPRKPPMDEKSLEESRKIFRF

SEQ ID NO: 202 - protein, 218 aa, Homo sapiens
MSMTLGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQAMDVSNQLARVCYSPDFEKLKPEYLEELPTMMQHFSQFLGKRPWFVGDKITFVDFLAYDVLDLHRIFEPNCLDAFPNLKDFISRFEGLEKISAYMKSSRFLPKPLYTRVAVWGNK

SEQ ID NO: 203 - protein, 443 aa, Homo sapiens
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKMRLQKHYPARLPTASIVICFYNEECNALFQTMSSVTNLTPHYFLEEIILVDDMSKVDDLKEKLDYHLETFRGKVKIIRNKKREGLIRARLIGASHASGDVLVFLDSHCEVNRVWLEPLLHAIAKDPKMVVCPLIDVIDDRTLEYKPSPLVRGTFDWNLQFKWDNVFSYEMDGPEGSTKPIRSPAMSGGIFAIRRHYFNEIGQYDKDMDFWGRENLELSLRIWMCGGQLFIIPCSRVGHISKKQTGKPSTIISAMTHNYLRLVHVWLDEYKEQFFLRKPGLKYVTYGNIRERVELRKRLGCKSFQWYLDNVFPELEASVNSL

SEQ ID NO: 204 - protein, 604 aa, Homo sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPELI

SEQ ID NO: 205 - protein, 190 aa, Homo sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 206 - protein, 839 aa, Homo sapiens
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSEHNGPMDGQSGTETKSDSTKDSSQHTKSSGEMEVD

SEQ ID NO: 207 - protein, 588 aa, Homo sapiens
MKLEFTEKNYNSFVLQNLNRQRKRKEYWDMALSVDNHVFFAHRNVLAAVSPLVRSLISSNDMKTADELFITIDTSYLSPVTVDQLLDYFYSGKVVISEQNVEELLRGAQYFNTPRLRVHCNDFLIKSICRANCLRYLFLAELFELKEVSDVAYSGIRDNFHYWASPEGSMHFMRCPPVIFGRLLRDENLHVLNEDQALSALINWVYFRKEDREKYFKKFFNYINLNAVSNKTLVFASNKLVGMENTSSHTTLIESVLMDRKQERPCSLLVYQRKGALLDSVVILGGQKAHGQFNDGVFAYIIQENLWMKLSDMPYRAAALSATSAGRYIYISGGTTEQISGLKTAWRYDMDDNSWTKLPDLPIGLVFHTMVTCGGTVYSVGGSIAPRRYVSNIYRYDERKEVWCLAGKMSIPMDGTAVITKGDRHLYIVTGRCLVKGYISRVGVVDCFDTSTGDVVQCITFPIEFNHRPLLSFQQDNILCVHSHRQSVEINLQKVKASKTTTSVPVLPNSCPLDVSHAICSIGDSKVFVCGGVTTASDVQTKDYTINPNAFLLDQKTGKWKTLAPPPEALDCPACCLAKLPCKILQRI

SEQ ID NO: 208 - protein, 638 aa, Homo sapiens
MSDKSELKAELERKKQRLAQIREEKKRKEEERKKKETDQKKEAVAPVQEESDLEKKRREAEALLQSMGLTPESPIVFSEYWVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 209 - protein, 940 aa, Homo sapiens
MGSGPIDPKELLKGLDSFLNRDGEVKSVDGISKIFSLMKEARKMVSRCTYLNILLQTRSPEILVKFIDVGGYKLLNNWLTYSKTTNNIPLLQQILLTLQHLPLTVDHLKQNNTAKLVKQLSKSSEDEELRKLASVLVSDWMAVIRSQSSTQPAEKDKKKRKDEGKSRTTLPERPLTEVKAETRAEEAPEKKREKPKSLRTTAPSHAKFRSTGLELETPSLVPVKKNASTVVVSDKYNLKPIPLKRQSNVAAPGDATPPAEKKYKPLNTTPNATKEIKVKIIPPQPMEGLGFLDALNSAPVPGIKIKKKKKVLSPTAAKPSPFEGKTSTEPSTAKPSSPEPAPPSEAMDADRPGTPVPPVEVPELMDTASLEPGALDAKPVESPGDPNQLTRKGRKRKSVTWPEEGKLREYFYFELDETERVNVNKIKDFGEAAKREILSDRHAFETARRLSHDNMEEKVPWVCPRPLVLPSPLVTPGSNSQERYIQAEREKGILQELFLNKESPHEPDPEPYEPIPPKLIPLDEECSMDETPYVETLEPGGSGGSPDGAGGSKLPPVLANLMGSMGAGKGPQGPGGGGINVQEILTSIMGSPNSHPSEELLKQPDYSDKIKQMLVPHGLLGPGPIANGFPPGGPGGPKGMQHFPPGPGGPMPGPHGGPGGPVGPRLLGPPPPPRGGDPFWDGPGDPMRGGPMRGGPGPGPGPYHRGRGGRGGNEPPPPPPPFRGARGGRSGGGPPNGRGGPGGGMVGGGGHRPHEGPGGGMGNSSGHRPHEGPGGGMGSGHRPHEGPGGSMGGGGGHRPHEGPGGGISGGSGHRPHEGPGGGMGAGGGHRPHEGPGGSMGGSGGHRPHEGPGHGGPHGHRPHDVPGHRGHDHRGPPPHEHRGHDGPGHGGGGHRGHDGGHSHGGDMSNRPVCRHFMMKGNCRYENNCAFYHPGVNGPPLP

SEQ ID NO: 210 - protein, 725 aa, Homo sapiens
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 211 - protein, 310 aa, Homo sapiens
MDRLLRLGGGMPGLGQGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 212 - protein, 418 aa, Homo sapiens
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPSPGLQPAHLTFPLDYHLNQPFIFVLRDTDTGALLFIGKILDPRGP

SEQ ID NO: 213 - protein, 538 aa, Homo sapiens
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQDTFDRERHKDPSPRDRDMQQLDSNLNSTRSQCNQVQDDLVETEKNLEESKNRSAISLLAAEEEINQLKKQLKSLQAQEDARHRNTDQRSSENRRSEPWSLEERKREQWNSLKQNADQQDTEAMSDYKKQLRNLKEEIAVLSAEKSALQGRSSRSRSPSPAPRSRSCSRSRSASPSTAVKVRRPSPNRSKLSNVARKAALLSRFSDSYSQARLDAQCLLRRCIDKAETVQRIIYIATVEAFHVAKMAFRHFKIHVRKSLTPSYVGSNDFENAVLDYVICHLDLYDSQSSVNDVIRAMNVNPKISFPPVVDFCLLSDFIQEICCIAFAMQALEPPLDIAYGADGEVFNDCKYRRSYDSDFTAPLVLYHVWPALMENDCVIMKGEAVTRRGAFWNSVRSVSRCRSRSLSPICPRSQIGLNTMSRSRSPSPIRCGLPRF

SEQ ID NO: 214 - protein, 234 aa, Homo sapiens
MHIPKSLQELANSEAVQFLRRPKTITRVFEGVFSLIVFSSLLTDGYQNKMESPQLHCILNSNSVACSFAVGAGFLAFLSCLAFLVLDTQETRIAGTRFKTAFQLLDFILAVLWAVVWFMGFCFLANQWQHSPPKEFLLGSSSAQAAIAFTFFSILVWIFQAYLAFQDLRNDAPVPYKRFLDEGGMVLTTLPLPSANSPVNMPTTGPNSLSYASSALSPCLTAPKSPRLAMMPDN

SEQ ID NO: 215 - protein, 299 aa, Homo sapiens
MTLSVLSRKDKERVIRRLLLQAPPGEFVNAFDDLCLLIRDEKLMHHQGECAGHQHCQKYSVPLCIDGNPVLLSHHNVMGDYRFFDHQSKLSFKYDLLQNQLKDIQSHGIIQNEAEYLRVVLLCALKLYVNDHYPKGNCNMLRKTVKSKEYLIACIEDHNYETGECWNGLWKSKWIFQVNPFLTQVTGRIFVQAHFFRCVNLHIEISKDLKESLEIVNQAQLALSFARLVEEQENKFQAAVLEELQELSNEALRKILRRDLPVTRTLIDWHRILSDLNLVMYPKLGYVIYSRSVLCNWII

SEQ ID NO: 216 - protein, 1044 aa, Homo sapiens
MGVALRKLTQWTAAGHGTGILEITPLNEAILKEIIVFVESFIYKHPQEAKFVFVEPLEWNTSLAPSAFESGYVVSETTVKSEEVDKNGQPLLFLSVPQIKIRSFGQLSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKLLLDMVGSPDQDLQEAAAGCISNIRRLALATEKARYT

SEQ ID NO: 217 - protein, 448 aa, Homo sapiens
MPGIKRILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 218 - protein, 970 aa, Homo sapiens
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 219 - protein, 522 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 220 - protein, 553 aa, Homo sapiens
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 221 - protein, 679 aa, Homo sapiens
MISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 222 - protein, 803 aa, Homo sapiens
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 223 - protein, 429 aa, Homo sapiens
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSNLRKLRNVSNLKPVPLIGPKLKRRWPISYCRELKGYSIPFMGSDVSVVRRTQRYLYENLEESPVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 224 - protein, 211 aa, Homo sapiens
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALLSCSCPGNESKAGYRVPRSYPKSNSSKEYV

SEQ ID NO: 225 - protein, 224 aa, Homo sapiens
MPGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 226 - protein, 249 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 227 - protein, 412 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 228 - protein, 604 aa, Homo sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRDDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 229 - protein, 124 aa, Homo sapiens
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMMRPTCVPLGASGPRIHHQGLWSCPARHFN

SEQ ID NO: 230 - protein, 274 aa, Homo sapiens
MATLKDQLIYNLLKEEQTPQNKITVVGVGAVGMACAISILMKDLADELALVDVIEDKLKGEMMDLQHGSLFLRTPKIVSGKVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 231 - protein, 472 aa, Homo sapiens
MATKCGNCGPGYSTPLEAMKGPREEIVYLPCIYRNTGTEAPDYLATVDVDPKSPQYCQVIHRLPMPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 232 - protein, 754 aa, Homo sapiens
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNKPASKDSRGIADPNQSAK

SEQ ID NO: 233 - protein, 854 aa, Homo sapiens
MMAYSDTTMMSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 234 - protein, 853 aa, Homo sapiens
MSEKVDWLQSQNGVCKVDVYSPGDNQAQDWKMDTSTDPVRVLSWLRRDLEKSTAEFQDVRFKPGESFGGETSNSGDPHKGFSVDYYNTTTKGTPERLHFEMTHKEIPCQGPRAQLGNGSSVDEVSFYANRLTNLVIAMARKEINEKIDGSENKCVYQSLYMGNEPTPTKSLSKIASELVNETVSACSRNAAPDKAPGSGDRVSGSSQSPPNLKYKSTLKIKESTKERQGPDDKPPSKKSFFYKEVFESRNGDYAREGGRFFPRERKRFRGQERPDDFTASVSEGIMTYANSVVSDMMVSIMKTLKIQVKDTTIATILLKKVLLKHAKEVVSDLIDSFLRNLHSVTGTLMTDTQFVSAVKRTVFSHGSQKATDIMDAMLRKLYNVMFAKKVPEHVRKAQDKAESYSLISMKGMGDPKNRNVNFAMKSETKLREKMYSEPKSEEETCAKTLGEHIIKEGLTLWHKTQQKECKSLGFQHAAFEAPNTQRKPASDISFEYPEDIGNLSLPPYPPEKPENFMYDSDSWAEDLIVSALLLIQYHLAQGGRRDARSFVEAAGTTNFPANEPPVAPDESCLKSAPIVGDQEQAEKKDLRSVFFNFIRNLLSETIFKRDQSPEPKVPEQPVKEDRKLCERPLASSPPRLYEDDETPGALSGLTKMAVSQIDGHMSGQMVEHLMNSVMKLCVIIAKSCDASLAELGDDKSGDASRLTSAFPDSLYECLPAKGTGSAEAVLQNAYQAIHNEMRGTSGQPPEGCAAPTVIVSNHNLTDTVQNKQLQAVLQWVAASELNVPILYFAGDDEGIQEKLLQLSAAAVDKGCSVGEVLQSVLRYEKERQLNEAVGNVTPLQLLDWLMVNL

SEQ ID NO: 235 - protein, 297 aa, Homo sapiens
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTVSVLNGGFRNWLKEGHPVTSEPSRPEPAVFKATLDRSLLKTYEQVLENLESKRFQLVDSRSQGRFLGTEPEPDAVGLDSGHIRGAVNMPFMDFLTEDGFEKGPEELRALFQTKKVDLSQPLIATCRKGVTACHVALAAYLCGKPDVAVYDGSWSEWFRRAPPESRVSQGKSEKA

SEQ ID NO: 236 - protein, 328 aa, Homo sapiens
MRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 237 - protein, 315 aa, Homo sapiens
MPLKLRGKKKAKSKETAGLVEGEPTGAGGGSLSASRAPARRLVFHAQLAHGSATGRVEGFSSIQELYAQIAGAFEISPSEILYCTLNTPKIDMERLLGGQLGLEDFIFAHVKGIEKEVNVYKSEDSLGLTITDNGVGYAFIKRIKDGGVIDSVKTICVGDHIESINGENIVGWRHYDVAKKLKELKKEELFTMKLIEPKKAFEIELRSKAGKSSGEKIGCGRATLRLRSKGPATVEEMPSETKAKAIEKIDDVLELYMGIRDIDLATTMFEAGKDKVNPDEFAVALDETLGDFAFPDEFVFDVWGVIGDAKRRGL

SEQ ID NO: 238 - protein, 543 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQKALDLDSSCKEAADGYQRCMMAQYNRHDSPEDVKRRAMADPEVQQIMSDPAMRLILEQMQKDPQALSEHLKNPVIAQKIQKLMDVGLIAIR

SEQ ID NO: 239 - protein, 1602 aa, Homo sapiens
MVDASGRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 240 - protein, 517 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 241 - protein, 374 aa, Homo sapiens
MARSLTWRCCPWCLTEDEKAAARVDQEINRILLEQKKQDRGELKLLLLGPGESGKSTFIKQMRIIHGAGYSEEERKGFRPLVYQNIFVSMRAMIEAMERLQIPFSRPESKHHASLVMSQDPYKVTTFEKRYAAAMQWLWRDAGIRAYYERRREFHLLDSAVYYLSHLERITEEGYVPTAQDVLRSRMPTTGINEYCFSVQKTNLRIVDVGGQKSERKKWIHCFENVIALIYLASLSEYDQCLEENNQENRMKESLALFGTILELPWFKSTSVILFLNKTDILEEKIPTSHLATYFPSFQGPKQDAEAAKRFILDMYTRMYTGCVDGPEGSKKGARSRRLFSHYTCATDTQNIRKVFKDVRDSVLARYLDEINLL

SEQ ID NO: 242 - protein, 645 aa, Homo sapiens
MSLKLPRNWDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 243 - protein, 494 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLNLQVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 244 - protein, 380 aa, Homo sapiens
MKKSIGILSPGVALGMAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 245 - protein, 1028 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 246 - protein, 1019 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 247 - protein, 325 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPY

SEQ ID NO: 248 - protein, 359 aa, Homo sapiens
MLSAASRVVSRAAVHCALRSPPPEARALAMSRPPPPRVASVLGTMEMGRRMDAPASAAAVRAFLERGHTELDTAFMYSDGQSETILGGLGLGLGGGDCRVKIATKANPWDGKSLKPDSVRSQLETSLKRLQCPQVDLFYLHAPDHGTPVEETLHACQRLHQEGKFVELGLSNYASWEVAEICTLCKSNGWILPTVYQGMYNATTRQVETELFPCLRHFGLRFYAYNPLAGGLLTGKYKYEDKDGKQPVGRFFGNSWAETYRNRFWKEHHFEAIALVEKALQAAYGASAPSVTSAALRWMYHHSQLQGAHGDAVILGMSSLEQLEQNLAATEEGPLEPAVVDAFNQAWHLVAHECPNYFR

SEQ ID NO: 249 - protein, 260 aa, Homo sapiens
MAKEWGYASHNGPDHWHELFPNAKGENQSPVELHTKDIRHDPSLQPWSVSYDGGSAKTILNNGKTCRVVFDDTYDRSMLRGGPLPGPYRLRQFHLHWGSSDDHGSEHTVDGVKYAAELHLVHWNPKYNTFKEALKQRDGIAVIGIFLKIGHENGEFQIFLDALDKIKTKGKEAPFTKFDPSCLFPACRDYWTYQGSFTTPPCEECIVWLLLKEPMTVSSDQMAKLRSLLSSAENEPPVPLVSNWRPPQPINNRVVRASFK

SEQ ID NO: 250 - protein, 98 aa, Homo sapiens
MNKHFLFLFLLYCLIVAVTSLQCITCHLRTRTDRCRRGFGVCTAQKGEACMLLRIYQRNTLQISYMVCQKFCRDMTFDLRNRTYVHTCCNYNYCNFKL

SEQ ID NO: 251 - protein, 404 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 252 - protein, 147 aa, Homo sapiens
MTSSLKIWGILLALLCILCRLCVYSNNIYWREFIKLHYLSPSREFKEYKCDVLMREKEALKGKSFHMFIYSLWFKIQRACINEKGSDRYRNAYVWAPGALKVLECHWEKYNNRYTESRSFSYIEFHCGVDGYVDNIEDLRIIEPISN

SEQ ID NO: 253 - protein, 61 aa, Homo sapiens
MKRFLFLLLTISLLVMVQIQTGLSGQNDTSQTSSPSASSNISGGIFLFFVANAIIHLFCFS

SEQ ID NO: 254 - protein, 1251 aa, Homo sapiens
MELSDVRCLTGSEELYTIHPTPPAGDGRSASRPQRLLWQTAVRHITEQRFIHGHRGGSGSGSGGSGKASDPAGGGPNHHAPQLSGDSALPLYSLGPGERAHSTCGTKVFPERSGSGSASGSGGGGDLGFLHLDCAPSNSDFFLNGGYSYRGVIFPTLRNSFKSRDLERLYQRYFLGQRRKSEVVMNVLDVLTKLTLLVLHLSLASAPMDPLKGILLGFFTGIEVVICALVVVRKDTTSHTYLQYSGVVTWVAMTTQILAAGLGYGLLGDGIGYVLFTLFATYSMLPLPLTWAILAGLGTSLLQVILQVVIPRLAVISINQVVAQAVLFMCMNTAGIFISYLSDRAQRQAFLETRRCVEARLRLETENQRQERLVLSVLPRFVVLEMINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQTEMNNQGVECLRLLNEIIADFDELLGEDRFQDIEKIKTIGSTYMAVSGLSPEKQQCEDKWGHLCALADFSLALTESIQEINKHSFNNFELRIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 255 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 256 - protein, 563 aa, Homo sapiens
MLLPAPALRRALLSRPWTGAGLRWKHTSSLKVANEPVLAFTQGSPERDALQKALKDLKGRMEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMGNVVLWKPSDTAMLASYAVYRILREAGLPPNIIQFVPADGPLFGDTVTSSEHLCGINFTGSVPTFKHLWKQVAQNLDRFHTFPRLAGECGGKNFHFVHRSADVESVVSGTLRSAFEYGGQKCSACSRLYVPHSLWPQIKGRLLEEHSRIKVGDPAEDFGTFFSAVIDAKSFARIKKWLEHARSSPSLTILAGGKCDDSVGYFVEPCIVESKDPQEPIMKEEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 257 - protein, 460 aa, Homo sapiens
MNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRNDNIPNAVWVWDIQKLRLFAVLEQLSPVRAFQWDPQQPRLAICTGGSRLYLWSPAGCMSVQVPGEGDFAVLSLCWHLSGDSMALLSKDHFCLCFLETEAVVGTACRQLGGHT

SEQ ID NO: 258 - protein, 364 aa, Homo sapiens
MSEVEAAAGATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 259 - protein, 823 aa, Homo sapiens
MKLFGFGSRRGQTAQGSIDHVYTGSGYRIRDSELQKIHRAAVKGDAAEVERCLARRSGDLDALDKQHRTALHLACTSGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKKKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNWDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTRDVSVQVEMSSAISKVKAENEFLTEQLSETQIKFNALKDKFRKTRDSLRKKSLALETVQNDLSQTQQQTQEMKEMYQNAEAKVNNSTGKWNCVEERICHLQRENAWLVQQLDDVHQKEDHKEIVTNIQRGFIESGKKDLVLEEKSKKLMNECDHLKESLFQYEREKTEGVVSIKEDKYFQTSRKTI

SEQ ID NO: 260 - protein, 326 aa, Homo sapiens
MAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTECKYLFSASMRIR

SEQ ID NO: 261 - protein, 295 aa, Homo sapiens
MVDSVYRTRSLGVAAEGLPDQYADGEAARVWQLYIGDTRSRTAEYKAWLLGLLRQHGCQRVLDVACGTGVDSIMLVEEGFSVTSVDASDKMLKYALKERWNRRHEPAFDKWVIEEANWMTLDKDVPQSAEGGFDAVICLGNSFAHLPDCKGDQSEHRLALKNIASMVRAGGLLVIDHRNYDHILSTGCAPPGKNIYYKSDLTKDVTTSVLIVNNKAHMVTLDYTVQVPGAGQDGSPGLSKFRLSYYPHCLASFTELLQAAFGGKCQHSVLGDFKPYKPGQTYIPCYFIHVLKRTD

SEQ ID NO: 262 - protein, 322 aa, Homo sapiens
MSSSPWEPATLRRVFVVGVGMTKFVKPGAENSRDYPDLAEEAGKKALADAQIPYSAVDQACVGYVFGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGGHSCS

SEQ ID NO: 263 - protein, 334 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQQKARDMYAEERKRQQLERDQATVTEQLLREGLQASGDAQLRRTRLHKLSARREERVQGFLQALELKRADWLARLGTASA

SEQ ID NO: 264 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 265 - protein, 745 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 266 - protein, 133 aa, Homo sapiens
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 267 - protein, 556 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 268 - protein, 763 aa, Homo sapiens
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 269 - protein, 1294 aa, Homo sapiens
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRKAGLILSQLGDLSSWCNGLLQEPKISLRRSSLKYLGCRYSEIKPYGLDWAELSRDLRKTCEEQTLSIPYNDYGDSKEI

SEQ ID NO: 270 - protein, 558 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 271 - protein, 942 aa, Homo sapiens; identical to SEQ ID NO: 76

SEQ ID NO: 272 - protein, 1047 aa, Homo sapiens
MEGRSAAAETFVWVNNASAHSQSVAKAKYEFLFGRSEGKAPDTSDHGGSTLLPPNVTNEFPEYGTMEEGGEGLRASLEFDGEALPCHPQEQQGVQPLTGCHSGLDSVTEGPKDVREAPSQSHLKEQSLQPIDSLISALKATEARIISGTLQATKVLDQDAVSSFSVQQVEKELDTASRKTQRVNKTLPAGQKNLPEIPLSAEVTTEESFYLSIQKDLTALLTGDTQAEISQIMNNGRKGAVCVQEPSCPLASLGSSAVTCHSAGSVGFLKEQRSALGREHPGGCDRSSSMGRPGRVKHVEFQGVEILWTGGDKRETQHPIDFETSLQRTASPDSKESSKVPRHLISSAGLCNSSSLTENVWDESWKAPSERPGTSSGTFSPVRLDESGEDEVFLQENKQHLEKTPKPERDRERISEQEEHVKGEDEDILGPGYTEDSTDVYSSQFETILDNTSLYYSAESLETLYSEPDSYFSFEMPLTPMIQQRIKEGGQFLERTSGGGHQDILSVSADGGIVMGYSSGVTNGLNDASDSIYTKGTPEIAFWGSNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 273 - protein, 331 aa, Homo sapiens
MSRQLSRARPATVLGAMEMGRRMDAPTSAAVTRAFLERGHTEIDTAFVYSEGQSETILGGLGLRLGGSDCRVKIDTKAIPLFGNSLKPDSLRFQLETSLKRLQCPRVDLFYLHMPDHSTPVEETLRACHQLHQEGKFVELGLSNYAAWEVAEICTLCKSNGWILPTVYQGMYNAITRQVETELFPCLRHFGLRFYAFNPLAGGLLTGKYKYEDKNGKQPVGRFFGNTWAEMYRNRYWKEHHFEGIALVEKALQAAYGASAPSMTSATLRWMYHHSQLQGAHGDAVILGMSSLEQLEQNLAAAEEGPLEPAVVDAFNQAWHLVTHECPNYFR

SEQ ID NO: 274 - protein, 180 aa, Homo sapiens
MADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGTMNAACELLGRLQAEVLECVSLVELTSLKGREKLAPVPFFSLLQYE

SEQ ID NO: 275 - protein, 201 aa, Homo sapiens
MANKGPSYGMSREVQSKIEKKYDEELEERLVEWIIVQCGPDVGRPDRGRLGFQVWLKNGVILSKLVNSLYPDGSKPVKVPENPPSMVFKQMEQVAQFLKAAEDYGVIKTDMFQTVDLFEGKDMAAVQRTLMALGSLAVTKNDGHYRGDPNWFMKKAQEHKREFTESQLQEGKHVIGLQMGSNRGASQAGMTGYGRPRQIIS

SEQ ID NO: 276 - protein, 640 aa, Homo sapiens
MHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 277 - protein, 117 aa, Homo sapiens
MKFVYKEEHPFEKRRSEGEKIRKKYPDRVPVIVEKAPKARIGDLDKKKYLVPSDLTVGQFYFLIRKRIHLRAEDALFFFVNNVIPPTSATMGQLYQEHHEEDFFLYIAYSDESVYGL

SEQ ID NO: 278 - protein, 266 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLNTSIVMPPRNLLELLINIKAGTYLPQSYLIHEHMVITDRIENIDHLGFFIYRLCHDKETYKLQRRETIKGIQKREASNCFAIRHFENKFAVETLICS

SEQ ID NO: 279 - protein, 478 aa, Homo sapiens
MACLNPVPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 280 - protein, 334 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 281 - protein, 430 aa, Homo sapiens
MASSAKSAEMPTISKTVNPTPDPHQEYLDPRITIALFEIGSHSPSSWGSLPFLKNSSHQVTEQQTAQKFNNLLKEIKDILKNMAGFEEKITEAKELFEETNITEDVSAHKENIRGLDKINEMLSTNLPVSLAPEKEDNEKKQEMILETNITEDVSAHKENIRGLDKINEMLSTNLPVSLAPEKEDNEKKQQMIMENQNSENTAQVFARDLVNRLEEKKVLNETQQSQEKAKNRLNVQEETMKIRNNMEQLLQEAEHWSKQHTELSKLIKSYQKSQKDISETLGNNGVGFQTQPNNEVSAKHELEEQVKKLSHDTYSLQLMAALLENECQILQQRVEILKELHHQKQGTLQEKPIQINYKQDKKNQKPSEAKKVEMYKQNKQAMKGTFWKKDRSCRSLDVCLNKKACNTQFNIHVARKALRGKMRSASSLR

SEQ ID NO: 282 - protein, 369 aa, Homo sapiens
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 283 - protein, 332 aa, Homo sapiens
MSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDLIF

SEQ ID NO: 284 - protein, 226 aa, Homo sapiens
MALSDVDVKKQIKHMMAFIEQEANEKAEEIDAKAEEEFNIEKGRLVQTQRLKIMEYYEKKEKQIEQQKKILMSTMRNQARLKVLRARNDLISDLLSEAKLRLSRIVEDPEVYQGLLDKLVLQGLLRLLEPVMIVRCRPQDLLLVEAAVQKAIPEYMTISQKHVEVQIDKEAYLAVNAAGGVEVYSGNQRIKVSNTLESRLDLSAKQKMPEIRMALFGANTNRKFFI

SEQ ID NO: 285 - protein, 244 aa, Homo sapiens
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 286 - protein, 268 aa, Homo sapiens
MAAVRVLVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 287 - protein, 745 aa, Homo sapiens
MSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 288 - protein, 392 aa, Homo sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQEECFLNLEAPISRVCGYDTPFPHIFEPFYIPDKWKCYDALRKMINY

SEQ ID NO: 289 - protein, 285 aa, Homo sapiens
MLLATFKLCAGSSYRHMRNMKGLRQQAVMAISQELNRRALGGPTPSTWINQVRRRSSLLGSRLEETLYSDQELAYLQQGEEAMQKALGILSNQEGWKKESQQDNGDKVMSKVVPDVGKVFRLEVVVDQPMERLYEELVERMEAMGEWNPNVKEIKVLQKIGKDTFITHELAAEAAGNLVGPRDFVSVRCAKRRGSTCVLAGMATDFGNMPEQKGVIRAEHGPTCMVLHPLAGSPSKTKLTWLLSIDLKGWLPKSIINQVLSQTQVDFANHLRKRLESHPASEARC

SEQ ID NO: 290 - protein, 308 aa, Homo sapiens
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 291 - protein, 167 aa, Homo sapiens
MIITTWIVYILARKGVGLPFLPITSSDIDVVESEAVSVLHHWLKKTEEEASRGIKEKLSINHPSQGVREKMSTDSPPTHGQDIHVTRDVVKHHLSKSDLLANQSQEVLEERTRIQFIRWSHTRIFQVPSEMTEDIMRDRIEQVRRSISRLTDVSAQDFSMRPSSSDC

SEQ ID NO: 292 - protein, 303 aa, Homo sapiens
MAAVAVLRAFGASGPMCLRRGPWAQLPARFCSRDPAGAGRRESEPRPTSARQLDGIRNIVLSNPKKRNTLSLAMLKSLQSDILHDADSNDLKVIIISAEGPVFSSGHDLKELTEEQGRDYHAEVFQTCSKVMMHIRNHPVPVIAMVNGLATAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 293 - protein, 553 aa, Homo sapiens
MAAPKTAAVGPLVGAVVQGTNSTRFLVFNSKTAELLSHHKVELTQEFPKEGWVEQDPKEILQSVYECIARTCEKLDELNIDISNIKAVGVSNQRETTVIWDKLTGEPLYNAVVWLDLRTQTTVEDLSKKIPGNSNFVKSKTGLPLSTYFSAVKLRWMLDNVRNVQKAVEEGRALFGTIDSWLIWSLTGGVNGGVHCTDVTNASRTMLFNIHSLEWDKELCDFFEIPMDLLPNVFSSSEIYGLIKTGALEGVPISGCLGDQCAALVGQMCFQEGQAKNTYGTGCFLLCNTGRKCVFSEHGLLTTVAYKLGREKPAYYALEGSVAIAGAVIRWLRDNLGIIETSGDIERLAKEVGTSYGCYFVPAFSGLYAPYWEPSARGILCGLTQFTNKCHIAFAALEAVCFQTREILEAMNRDCGIPLRHLQVDGGMTNNKVLMQLQADILHIPVIKPFMPETTALGAAMAAGAAEGVSVWSLEPQALSVLRMERFEPQIQATESEIRYATWKKAVMKSMGWVTSQSPEGGDPSIFSSLPLGFFIVSSMVMLIGARYISGVP

SEQ ID NO: 294 - protein, 996 aa, Homo sapiens
MDEDTHYDKVEDVVGSHIEDAVTFWAQSINRNKDIMKIGCSLSEVCPQASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSEKMTLDLKDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 295 - protein, 610 aa, Homo sapiens
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 296 - protein, 459 aa, Homo sapiens
MASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLPASGSLYYFNYLDSTAYPPSELLSGHLFPSGLLNAQAPAALAAHPKLFLLENAKLAGLAADKFPHPAPYPHKERLPAPLEQVLKENSALTAERGGVKGHSKLPGGSADGKPKNFTCEVCGKVFNAHYNLTRHMPVHTGARPFVCKVCGKGFRQASTLCRHKIIHTQEKPHKCNQCGKAFNRSSTLNTHIRIHAGYKPFVCEFCGKGFHQKGNYKNHKLTHSGEKQYKCTICNKAFHQVYNLTFHMHTHNDKKPFTCATCGKGFCRNFDLKKHVRKLHDSVGPAAPSAKDLTRTVQS

SEQ ID NO: 297 - protein, 505 aa, Homo sapiens
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPGPSEISTEVKYVAGETNAKENENSSPVAGAFGVFSTISTAVQSTGKSVISGGLDALEFIGKKTMDVIAEGDPGFKRTKGLMNRNATLSQVLREAKEKEEIRTSNEVTVETDKKTHYGLLFDEFQGLSHLEALEMLSQESEIKVKSILNSLSGEELETLKVELEQLKETFSLAEFCEEEEEEKKGDEDFTKDITELFSQLHVSSKPEKLARARNTAHEWIRKSLTKPLAENEEGEKQSEAENTEQVNKNSIEDIHAFAIRSLAELTACSIELFHKTAALVLHGRKQEVTAIERSQTLSQMTIVLCKELSSLSKEFTTCLTTAGVKEMADVLNPLITAVFLEASNSASYIQDAFQLLLPVLEISLIENKIESHRHELQGQKPLLEH

SEQ ID NO: 298 - protein, 673 aa, Homo sapiens
MASQFCLPESPCLSPLKPLKPHFGDIQEGIYVAIQRSDKRIHLAVVTEINRENYWVTVEWVEKAVKKGKKIDLETILLLNPALDSAEHPMPPPPLSPLALAPSSAIRDQRTATKWVAMIPQKNQTASGDSLDVRVPSKPCLMKQKKSPCLWEIQKLQEQREKRRRLQQEIRARRALDVNTRNPNYEIMHMIEEYRRHLDSSKISVLEPPQEHRICVCVRKRPLNQRETTLKDLDIITVPSDNVVMVHESKQKVDLTRYLQNQTFCFDHAFDDKASNELVYQFTAQPLVESIFRKGMATCFAYGQTGSGKTYTMGGDFSGTAQDCSKGIYALVAQDVFLLLRNSTYEKLDLKVYGTFFEIYGGKVYDLLNWKKKLQVLEDGNQQIQVVGLQEKEVCCVEEVLNLVEIGNSCRTSRQTPVNAHSSRSHAVFQIILKSGRIMHGKFSLVDLAGNERGADTTKASRKRQLEGAEINKSLLALKECILALGQNKPHTPFRASKLTLVLRDSFIGQNSSTCMIATISPGMTSCENTLNTLRYANRVKKLNVDVRPYHRGHYPIGHEAPRMLKSHIGNSEMSLQRDEFIKIPYVQSEEQKEIEEVETLPTLLGKDTTISGKGSSQWLENIQERAGGVHHDIDFCIARSLSILEQKIDALTEIQKKLKLLLADLHVKSKVE

SEQ ID NO: 299 - protein, 212 aa, Homo sapiens
MAQTDKPTCIPPELPKMLKEFAKAAIRAQPQDLIQWGADYFEALSRGETPPVRERSERVALCNWAELTPELLKILHSQVAGRLIIRAEELAQMWKVVNLPTDLFNSVMNVGRFTEEIEWLKFLALACSALGVTITKTLKIVCEVLSCDHNGGLPRIPFSTFQFLYTYIAEVDGEICASHVSRMLNYIEQEVIGPDGLITVNDFTQNPRVWLE

SEQ ID NO: 300 - protein, 493 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 301 - protein, 852 aa, Homo sapiens
MSGRARVKARGIARSPSATEVGRIQASPLPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKIIKVQENPAAFVRAIQQYVDPDVQLVMCILPSNQKTYYDSIKKYLSSDCPVPSQCVLARTLNKQGMMMSIATKIAMQMTCKLGGELWAVEIPLKSLMVVGIDVCKDALSKDVMVVGCVASVNPRITRWFSRCILQRTMTDVADCLKVFMTGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 302 - protein, 394 aa, Homo sapiens
MATAQLQRTPMSALVFPNKISTEHQSLVLVKRLLAVSVSCITYLRGIFPECAYGTRYLDDLCVKILREDKNCPGSTQLVKWMLGCYDALQKKYLRMVVLAVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 303 - protein, 136 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKLGGVKKSATLRSFEGLIFNKYTLNQGRN

SEQ ID NO: 304 - protein, 685 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 305 - protein, 646 aa, Homo sapiens
MSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTKKTEELRKTVEDLDGLIHQIYRDQDLTQEIAMEHFVKKVEAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 306 - protein, 640 aa, Homo sapiens
MFSCVKPYEDQNYSALRRDCRRRKVLFEDPLFPATDDSLYYKGTPGPAVRWKRPKGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 307 - protein, 565 aa, Homo sapiens
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 308 - protein, 415 aa, Homo sapiens
MKLKSLLLRYYPPGIMLEYEKHGELKTKSIDLLDLGPSTDVSALVEEIQKAEPLLTASRTEQVKLLIQRLQEKLGQNSNHTFYLFKVLKAHILPLTNVALNKSGSCFITGSYDRTCKLWDTASGEELNTLEGHRNVVYAIAFNNPYGDKIATGSFDKTCKLWSVETGKCYHTFRGHTAEIVCLSFNPQSTLVATGSMDTTAKLWDIQNGEEVYTLRGHSAEIISLSFNTSGDRIITGSFDHTVVVWDADTGRKVNILIGHCAEISSASFNWDCSLILTGSMDKTCKLWDATNGKCVATLTGHDDEILDSCFDYTGKLIATASADGTARIFSAATRKCIAKLEGHEGEISKISFNPQGNHLLTGSSDKTARIWDAQTGQCLQVLEGHTDEIFSCAFNYKGNIVITGSKDNTCRIWR

SEQ ID NO: 309 - protein, 956 aa, Homo sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 310 - protein, 192 aa, Homo sapiens
MAPLGGAPRLVLLFSGKRKSGKDFVTEALQSRLGADVCAVLRLSGPLKEQYAQEHGLNFQRLLDTSTYKEAFRKDMIRWGEEKRQADPGFFCRKIVEGISQPIWLVSDTRRVSDIQWFREAYGAVTQTVRVVALEQSRQQRGWVFTPGVDDAESECGLDNFGDFDWVIENHGVEQRLEEQLENLIEFIRSRL

SEQ ID NO: 311 - protein, 902 aa, Homo sapiens
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDFHSCLGWMQWRGLSSLQPPPPRFKDSPASAFRVAGITDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 312 - protein, 194 aa, Homo sapiens; identical to SEQ ID NO: 13

SEQ ID NO: 313 - protein, 339 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 314 - protein, 140 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKGLF

SEQ ID NO: 315 - protein, 679 aa, Homo sapiens; identical to SEQ ID NO: 221

SEQ ID NO: 316 - protein, 188 aa, Homo sapiens
MNGDDAFARRPRAGSQIPEKIQKAFDDIAKYFSKKEWEKMKSSEKIIYVYMKRKYEAMTKLGFKATLPPFMCNTGATDLQGNDFDNDRNHRNQVERSQMTFGRLQGIFPKIMPKKPAEVGNDSKEVPEASGLQNDGKQLCPPGKPTTSEKINKASGPKRGKHAWTHRLRERKQLVIYEEISDPEEDDE

SEQ ID NO: 317 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 318 - protein, 495 aa, Homo sapiens
MSMLVVFLLLWGVTWGPVTEAAIFYETQPSLWAESESLLKPLANVTLTCQAHLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 319 - protein, 944 aa, Homo sapiens
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

What the claim is:

1. A method for detecting expression of male fertility-associated proteins from a male human individual, comprising:
   (a) obtaining a seminal plasma sample from a human subject to be tested; and
   (b) detecting male fertility-associated proteins including HEL-S-65p, HEL-S-6a and HEL-S-162eP in the seminal plasma by contacting the seminal plasma sample with capture reagents including anti-HEL-S-65p, anti-HEL-S-6a and anti-HEL-S-162eP monoclonal antibodies and detecting the binding between the male fertility-associated proteins and the capture reagents, wherein each of the capture reagents is conjugated with a marker.

2. The method according to claim 1, wherein said male fertility-associated proteins further comprise at least 5, 10, 15, 20, 25, 30, 40, 50, 60, 70, 80, 90, 100, 150, 200, 250, 300 proteins listed in Table 2.

3. The method according to claim 1, wherein a first signal is produced by the marker when the capture reagent binds one or more of the male fertility-associated proteins.

4. The method according to claim 1, wherein said detecting is a qualitative or a quantitative detection.

5. The method according to claim 1, wherein said detecting is a qualitative or a quantitative detection for sperm localization proteins in a seminal plasma sample from a male individual.

6. The method according to claim 1, wherein said male individual is a human including an infertile male or a male having no child within 1 year after marriage.

7. The method according to claim 1, wherein said male fertility-associated proteins further comprises one or more of the following proteins represented by the series number in Table 2: 3, 4, 5, 8, 9, 10, 11, 12, 13, 14, 15, 16, 17, 18, 19, 20, 21, 22, 23, 24, 25, 26, 27, 28, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 87, 88, 89, 94, 95, 96, 97, 98, 99, 100, 101, 109, 111, 112, 113, 114, 115, 117, 129, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 227, 228, 229, 231, 232, 233, 234, 235, 236, 237, 238, 239, 240, 241, 242, 243, 244, 245, 246, 247, 248, 249, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 313, 314, 315, 316, and 319.

8. The method according to claim 1, wherein said marker is a chromogenic substrate, and a first signal being fluorescence produced by the chromogenic substrate when said capture reagent binds one or more of the male fertility-associated proteins.

9. The method according to claim 8, wherein said male fertility-associated proteins further comprises at least 5, 10, 15, 20, 25, 30, 40, 50, 60, 70, 80, 90, 100, 150, 200, 250, 300 proteins listed in Table 2.

10. The method according to claim 8, wherein said detecting is a qualitative or a quantitative detection for sperm localization proteins in a seminal plasma sample from the male individual.

11. The method according to claim 8, wherein said detecting is a qualitative or a quantitative detection of localization of proteins on sperm from a male individual.

12. The method according to claim 8, wherein said male individual is a human including an infertile male or a male having no child within 1 year after marriage.

13. The method according to claim 8, wherein said male infertility-associated proteins further comprises one or more of the following proteins indicated by the series number in Table 2: 3, 4, 5, 6, 8, 9, 10, 11, 12, 13, 14, 15, 16, 17, 18, 19, 20, 21, 22, 23, 24, 25, 26, 27, 28, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 87, 88, 89, 94, 95, 96, 97, 98, 99, 100, 101, 107, 109, 111, 112, 113, 114, 115, 117, 129, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 227, 228, 229, 231, 232, 233, 234, 235, 236, 237, 238, 239, 240, 241, 242, 243, 244, 245, 246, 247, 248, 249, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 313, 314, 315, 316, and 319.

14. The method according to claim 1, wherein the capture reagents further comprise an auxiliary capture reagent for a human sperm maturation or male fertility-associated protein listed in Table 2 other than HEL-S-65p, HEL-S-6a or HEL-S-162eP.

15. The method of claim 1, wherein the capture reagents including monoclonal antibodies are immobilized on a protein chip, the protein chip contains one or more detection zones selected from the group consisting of a detection zone for sperm capacitation, a detection zone for sperm motility related proteins, and a detection zone for sperm penetration related proteins, the protein chip comprises:
a solid phase support and detection points of the capture reagents for human sperm maturation and male fertility-associated proteins on said solid phase support.

16. A method for detecting expression of male fertility-associated proteins from a male human individual, comprising:
(a) obtaining a seminal plasma sample from a human subject to be tested;
(b) contacting the seminal plasma sample from the subject to be tested with capture reagents for detecting male fertility-associated proteins, wherein the male fertility-associated proteins include HEL-S-65p, HEL-S-6a and HEL-S-162eP, the capture reagents include mouse anti-HEL-S-65p, mouse anti-HEL-S-6a, and mouse anti-HEL-S-162eP antibodies, each of the capture reagents is conjugated to a marker, a first signal is produced by the marker when the capture reagents capture the male fertility-associated proteins; and
(c) comparing the first signal with a standard signal for detection of the expression of the male infertility-associated proteins.

* * * * *